(12) United States Patent
Van Meter

(10) Patent No.: US 11,988,676 B2
(45) Date of Patent: May 21, 2024

(54) PROTEIN BIOMARKER INDICATORS OF NEUROLOGICAL INJURY AND/OR DISEASE AND METHODS OF USE THEREOF

(71) Applicant: BRAINBOX SOLUTIONS, INC., Richmond, VA (US)

(72) Inventor: Timothy E. Van Meter, Richmond, VA (US)

(73) Assignee: BRAINBOX SOLUTIONS, INC., Richmond, VA (US)

(*) Notice: Subject to any disclaimer, the term of this patent is extended or adjusted under 35 U.S.C. 154(b) by 745 days.

(21) Appl. No.: 16/763,794

(22) PCT Filed: Nov. 15, 2018

(86) PCT No.: PCT/US2018/061372
§ 371 (c)(1),
(2) Date: May 13, 2020

(87) PCT Pub. No.: WO2019/099732
PCT Pub. Date: May 23, 2019

(65) Prior Publication Data
US 2020/0355701 A1    Nov. 12, 2020

Related U.S. Application Data

(60) Provisional application No. 62/587,272, filed on Nov. 16, 2017.

(51) Int. Cl.
*G01N 33/68* (2006.01)
*C07K 16/28* (2006.01)
*C07K 16/36* (2006.01)

(52) U.S. Cl.
CPC ..... *G01N 33/6896* (2013.01); *C07K 16/2803* (2013.01); *C07K 16/36* (2013.01); *G01N 33/6848* (2013.01); *G01N 2333/705* (2013.01); *G01N 2333/755* (2013.01); *G01N 2333/825* (2013.01)

(58) Field of Classification Search
CPC ........... G01N 33/6896; G01N 33/6848; G01N 2333/755; G01N 2333/705; G01N 2333/825; G01N 33/564; C07K 16/36; C07K 16/2803
See application file for complete search history.

(56) References Cited

U.S. PATENT DOCUMENTS

2017/0145506 A1    5/2017  Merchant-Borna et al.

FOREIGN PATENT DOCUMENTS

WO    2016/205828 A2    12/2016

OTHER PUBLICATIONS

De Oliveira et al., J Neurotrauma, 4:1331-1338, Aug. 2007 (Year: 2007).*
Lizhnyak et al., Expert Rev Proteomics, 12(): 75-82, Feb. 2015 (Year: 2015).*
De Oliveira et al., J Neurotrauma. Aug. 2007; 24(8):1331-8. (Year: 2007).*
Glessner et al., Nature, 459(7246): 569-573, May 2009 (Year: 2009).*
Lionel et al., Human Molecular Genetics, 23(10): 2752-2768, Dec. 2013 (Year: 2013).*
International Search Report and Written Opinion in International Application No. PCT/US2018/061372, dated Mar. 26, 2019.
International Preliminary Report on Patentability in International Application No. PCT/US2018/061372, dated Mar. 28, 2020.

* cited by examiner

*Primary Examiner* — Kimberly Ballard
*Assistant Examiner* — Stacey N Macfarlane
(74) *Attorney, Agent, or Firm* — RAPHAEL BELLUM PLLC

(57) ABSTRACT

Methods, compositions and kits useful in the detection, assessment, diagnosis, prognosis and/or treatment of neurological injury or disease or brain injury, such as traumatic brain injury (TBI), are provided in which certain newly discovered protein biomarkers are detected in a biological sample of a subject undergoing testing or evaluation. The methods allow for detection of changes in levels, amounts, or concentrations of the protein biomarkers in a subject compared with those of controls. Detection of the protein biomarkers, and/or levels thereof, provides an indication of biological and biochemical events, e.g., at a cellular level, that are occurring in the subject who is undergoing testing or analysis for the neurological injury or brain injury.

14 Claims, 20 Drawing Sheets
Specification includes a Sequence Listing.

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 1 | 14-3-3 protein sigma (SFN) | SEQ ID NO 1 | NP_006133.1 14-3-3 protein sigma [Homo sapiens] | 28 kDa | structural | Ubiquitous | Nuclear | Unknown |
| 2 | 1-phosphatidylinositol 4,5-bisphosphate phosphodiesterase eta-1 (PLCH1) | SEQ ID NO 2 | NP_001336180.1 1-phosphatidyl inositol 4,5bisphosphate phosphodiesterase eta-1 isoform d [Homo sapiens] | 189 kDa | Cell signaling | Ubiquitous | Cell membrane | Membrane repair |
| 3 | ATP Binding Cassette sub-family A member 2 (ABCA2) | SEQ ID NO 3 | NP_001597.2 ATP-binding cassette sub-family A member 2 isoform a [Homo sapiens] | 47 kDa | Proteolysis | Ubiquitous | extracellular | Inflammation |
| 4 | Alpha-1-antitrypsin (SERPINA1) | SEQ ID NO 4 | NP_001121179.1 alpha-1-antitrypsin precursor [Homo sapiens] | 47 kDa | Metabolic enzyme | Ubiquitous | cytoplasm | Neurodegeneration |
| 5 | Ankyrin repeat domain-containing protein 20A4 (ANKRD20A4) | SEQ ID NO 5 | NP_001092275.1 ankyrin repeat domain-containing protein 20A4 [Homo sapiens] | 94 kDa | Unknown | Unknown | Nucleus | Unknown |
| 6 | Annexin A2 (ANXA2) | SEQ ID NO 6 | NP_001002858.1 annexin A2 isoform 1 [Homo sapiens] | 39 kDa | Cell adhesion | Ubiquitous | Cell membrane | Synaptogenesis |
| 7 | AP-3 complex subunit beta-2 (AP3B2) | SEQ ID NO 7 | NP_001265441.1 AP-3 complex subunit beta-2 isoform 1 [Homo sapiens] | 119 kDa | Gene regulation | Neurons, brain specific | cytoplasm nucleus | Synaptogenesis |
| 8 | Apolipoprotein A-I (APOA1) | SEQ ID NO 8 | NP_001304947.1 apolipoprotein A-I isoform 1 preproprotein [Homo sapiens] | 31 kDa | Lipid binding | Blood | extracellular | Inflammation |

FIG. 1A

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 9 | Apolipoprotein B-100 (APOB) | SEQ ID NO 9 | NP_000375.2 apolipoprotein B-100 | 516 kDa | Lipid binding | Blood | extracellular | Inflammation |
| 10 | Apolipoprotein E (APOE) | SEQ ID NO 10 | NP_001289617.1 apolipoprotein E isoform a precursor [Homo sapiens] | 36 kDa | Lipid binding | Blood | extracellular | Neurodegeneration |
| 11 | Arginase-1 (ARG1) | SEQ ID NO 11 | XP_011534103.1 PREDICTED: arginase-1 isoform X1 [Homo sapiens] | 35 kDa | Metabolic enzyme | Ubiquitous | extracellular | Metabolism |
| 12 | Astrotactin-2 (ASTN2) | SEQ ID NO 12 | NP_054729.3 astrotactin-2 isoform a precursor [Homo sapiens] | 148 kDa | Cell adhesion | Neuron/glia | Cell membrane | Synaptogenesis |
| 13 | Bile acid receptor (NR1H4) | SEQ ID NO 13 | NP_001193906.1 bile acid receptor isoform 1 [Homo sapiens] | 270 kDa | Involved in microtubule trafficking | Interneurons, muscle | Cell membrane | Synaptogenesis |
| 14 | Biorientation of chromosomes in cell division protein 1-like 1 (BOD1L1) | SEQ ID NO 14 | NP_683692.2 biorientation of chromosomes in cell division protein 1-like 1 [Homo sapiens] | 56 kDa | Metabolic enzyme | Blood, heart, liver | Nucleus | Metabolism |
| 15 | Calcium-activated potassium channel subunit alpha-1 (KCNMA1) | SEQ ID NO 15 | AAI44497.1 KCNMA1 protein [Homo sapiens] | 330 kDa | Gene regulation | Blood, liver, heart | Nucleus | Metabolism |
| 16 | Calmodulin (CALM1) | SEQ ID NO 16 | NP_008819.1 calmodulin-1 [Homo sapiens] | 329 kDa | Cell adhesion | Neuron-specific | Cell membrane | Synaptogenesis |

FIG. 1B

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 17 | Calmodulin-like protein 3 (CALML3) | SEQ ID NO 17 | NP_005176.1 calmodulin-like protein 3 [Homo sapiens] | 138 kDa | Synapse | Neuron/glia | Membrane | Synaptogenesis |
| 18 | Calmodulin-like protein 5 (CALML5) | SEQ ID NO 18 | NP_059118.2 calmodulin-like protein 5 [Homo sapiens] | 17 kDa | Synapse | Neuron/glia | cytoplasm | Synaptogenesis |
| 19 | Carbonic anhydrase 1 (CAH1) | SEQ ID NO 19 | NP_001122301.1 carbonic anhydrase 1 isoform a [Homo sapiens] | 17 kDa | Synapse | Neuron/glia | cytoplasm | Synaptogenesis |
| 20 | Caspase-14 (CASP14) | SEQ ID NO 20 | NP_036246.1 caspase-14 precursor [Homo sapiens] | 16 kDa | Synapse | Skin, blood | Blood | Synaptogenesis |
| 21 | Catenin alpha-1 (CTNNA1) | SEQ ID NO 21 | NP_001310912.1 catenin alpha-1 isoform 1 [Homo sapiens] | 29 kDa | Metabolic enzyme | Metabolic enzyme | Cytoplasm | Inflammation |
| 22 | Cathepsin D (CTSD) | SEQ ID NO 22 | NP_001900.1 cathepsin D preproprotein [Homo sapiens] | 28 kDa | Proteolysis | Cell death | extracellular | Apoptosis |
| 23 | Cadherin EGF LAG seven-pass G-type receptor 1 (CELSR1) | SEQ ID NO 23 | NP_055061.1 cadherin EGF LAG seven-pass G-type receptor 1 precursor [Homo sapiens] | 100 kDa | Cell signaling | Brain | Cytoplasm | Synaptogenesis |

FIG. 1C

| | | | | Proteolysis | Ubiquitous | Lysosome, extracellular | Necrosis |
|---|---|---|---|---|---|---|---|
| 24 | Clusterin (CLU) | SEQ ID NO 24 | NP_001822.3 clusterin preproprotein [Homo sapiens] | | | | |
| 25 | Coagulation factor XII (F12) | SEQ ID NO 25 | AAA70225.1 coagulation factorXII precursor, partial [Homo sapiens] | 52 kDa | Cell adhesion | Blood | extracellular | Neurodegeneration |
| 26 | Complement C4-A (C4A) | SEQ ID NO 26 | NP_009224.2 complement C4-A isoform 1 preproprotein [Homo sapiens] | 68 kDa | Inflammation | Blood | extracellular | Vascular repair |

FIG. 1C
CONTINUED

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 27 | Complement component C9 (C9) | SEQ ID NO 27 | NP_001728.1 complement component C9 preproprotein [Homo sapiens] | 193 kDa | Inflammation | Blood | extracellular | Innate immunity |
| 28 | Complement factor H (CFH) | SEQ ID NO 28 | AAI42700.1 Complement factor H [Homo sapiens] | 63 kDa | Inflammation | Blood | extracellular | Innate immunity |
| 29 | Complement factor H-related protein 1 (CFHR1) | SEQ ID NO 29 | NP_002104.2 complement factor H-related protein 1 precursor [Homo sapiens] | 139 kDa | Inflammation | Blood | extracellular | Innate immunity |
| 30 | Cullin 7 (CUL7) | SEQ ID NO 30 | NP_001161842.1 cullin-7 isoform 1 | 38 kDa | Inflammation | Blood | extracellular | Innate immunity |
| 31 | Desmocollin-1 (DSC1) | SEQ ID NO 31 | NP_077739.1 desmocollin-1 isoform Dsc1a preproprotein [Homo sapiens] | 191 kDa | Gene expression | Neurons/Epithelia | Nucleus | Vascular repair |
| 32 | Disintegrin and metalloproteinase domain-containing protein 8 (ADAM8) | SEQ ID NO 32 | NP_001100.3 disintegrin and metalloproteinase domain-containing protein 8 isoform 1 precursor [Homo sapiens] | 100 kDa | Cell adhesion | Neurons/Epithelia | Cell membrane | Synaptogenesis |

FIG. 1D

| 33 | Dispatched Homolog 2 (DISP2) | SEQ ID NO 33 | NP_277045.1 protein dispatched homolog 2 [Homo sapiens] | 89 kDa | Proteolysis | Ubiquitous | extracellular | Apoptosis |
| 34 | Enolase 1 (ENO1) | SEQ ID NO 34 | NP_001419.1 alpha-enolase isoform 1 [Homo sapiens] | 15 kDa | Lipid binding | Blood | extracellular | inflammation |
| 35 | Fatty acid-binding protein, epidermal (FABP5) | SEQ ID NO 35 | NP_001435.1 fatty acid-binding protein, epidermal [Homo sapiens] | 144 kDa | Cell signaling | Neuron, other | Dendrite morphology | Synaptogenesis |

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 36 | FERM and PDZ domain-containing protein 4 (FRMPD4) | SEQ ID NO 36 | NP_055543.2 FERM and PDZ domain-containing protein 4 [Homo sapiens] | 42 kDa | Inflammation /Proteolysis | Ubiquitous | extracellular | Inflammation |
| 37 | Fetuin-B (FETUB) | SEQ ID NO 37 | NP_055190.2 fetuin-B isoform 1 precursor [Homo sapiens] | 312 kDa | Extracellular matrix, glucose regulation | | extracellular | Metabolism |
| 38 | Fibrillin-1 (FBN1) | SEQ ID NO 38 | NP_000129.3 fibrillin-1 prepro-protein [Homo sapiens] | 15 kDa | Cell adhesion | Neurons/Epithelia | Cell-cell adhesion | Synaptogenesis |
| 39 | Galectin-7 (LGALS7) | SEQ ID NO 39 | NP_002298.1 galectin-7 [Homo sapiens] | 21 kDa | Metabolic enzyme | Ubiquitous | Intra/extrac-ellular | Metabolism |
| 40 | Gamma-glutamylcyclot-ransferase (GGCT) | SEQ ID NO 40 | NP_076956.1 gamma-glutamylcyclotransferase isoform 1 [Homo sapiens] | 26 kDa | Metabolic enzyme | Ubiquitous | Plasma | Metabolism |
| 41 | Glutathione peroxidase 3 (GPX3) | SEQ ID NO 41 | NP_002075.2 glutathione peroxidase 3 | 21 kDa | Metabolic enzyme | Ubiquitous | Cell membrane | Membrane repair |
| 42 | Group XIIA secretory phospholipase A2 (PLA2G12A) | SEQ ID NO 42 | NP_110448.2 group XIIA secretory phospholipase A2 precursor [Homo sapiens] | 45 kDa | Protein binding | Ubiquitous | extracellular | Unknown |

| 43 | Haptoglobin (HP) | SEQ ID NO 43 | NP_005134.1 haptoglobin isoform 1 preproprotein [Homo sapiens] | 60 kDa | Clotting/ Inflammation | Ubiquitous | extracellular | Inflammation |
| 44 | Histidine-rich glycoprotein (HRG) | SEQ ID NO 44 | NP_000403.1 histidine-rich glyco protein precursor [Homo sapiens] | 432 kDa | Gene regulation | Ubiquitous | Nucleus | Neurogenesis |

FIG. 1E
CONTINUED

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 45 | Histone-lysine N-methyltransferase 2A (KMT2A) | SEQ ID NO 45 | NP_001184033.1 histone-lysine N-methyltransferase 2A isoform 1 precursor [Homo sapiens] | 367 kDa | Cell adhesion | Neuroepithelial cells | Cell Membrane | Synaptogenesis |
| 46 | Kallikrein-plasma (KLKB1) | SEQ ID NO 46 | NP_000883.2 plasma kallikrein isoform 1 preproprotein [Homo sapiens] | 38 kDa | Gene regulation | Ubiquitous | Extracellular | Unknown |
| 47 | Laminin subunit alpha-3 (LAMA3) | SEQ ID NO 47 | NP_937762.2 laminin subunit alpha-3 isoform 1 precursor [Homo sapiens] | 522 kDa | Cell adhesion | Ubiquitous | Cell membrane | Synaptogenesis |
| 48 | Leucine-rich alpha-2-glycoprotein (LRG1) | SEQ ID NO 48 | NP_443204.1 leucine-rich alpha-2-glycoprotein precursor [Homo sapiens] | 6 kDa | Cell toxicity | Brain | Nuclear, extracellular | Metabolism |
| 49 | Low-density lipoprotein receptor-related protein 2 (LRP2) | SEQ ID NO 49 | NP_004516.2 low-density lipoprotein receptor-related protein 2 precursor [Homo sapiens] | 122 kDa | Cell adhesion/ Cell death | Astrocytes, macrophages | Cell membrane | Necrosis |
| 50 | Metallothionein-1X (MT1X) | SEQ ID NO 50 | NP_005943.1 metallothionein-1X [Homo sapiens] | 62 kDa | Metabolic enzyme | Ubiquitous | Cytoplasm | Metabolism |

FIG. 1F

| 51 | Multiple epidermal growth factor-like domains protein 10 (MEGF10) | SEQ ID NO 51 | NP_001243474.1 multiple epidermal growth factor-like domains protein 10 isoform a precursor [Homo sapiens] | 256 kDa | Cell adhesion | Neurons | Axon/synapse | Synaptogenesis |
|---|---|---|---|---|---|---|---|---|
| 52 | Neuronal Navigator 3 (NAV3) | SEQ ID NO 52 | NP_001019554.1 neuron navigator 3 isoform 1 [Homo sapiens] | 71 kDa | Proteolysis | Ubiquitous | extracellular | Necrosis |

FIG. 1F
CONTINUED

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 53 | N-acetylmuramoyl-L-alanine amidase (PGLYRP2) | SEQ ID NO 53 | NP_443122.3 N-acetylmuramoyl-L-alanine amidase precursor [Homo sapiens] | 105 kDa | Gene regulation | Ubiquitous | Nucleus, cytoplasm | Neurogenesis |
| 54 | Proprotein convertase subtilisin/kexin type 5 (PCSK5) | SEQ ID NO 54 | AAH12064.1 Proprotein convertase subtilisin/kexin type 5 [Homo sapiens] | 100 kDa | Gene regulation | Ubiquitous | Nucleus | Neurogenesis |
| 55 | Pre-mRNA-splicing factor CWC22 homolog (CWC22) | SEQ ID NO 55 | NP_065994.1 pre-mRNA-splicing factor CWC22 homolog [Homo sapiens] | 207 kDa | Proteolysis | Ubiquitous | extracellular | Synaptogenesis |
| 56 | Protein S100-A11 (S100A11) | SEQ ID NO 56 | NP_005611.1 protein S100-A11 [Homo sapiens] | 152 kDa | Cell signaling | Ubiquitous | Cell Membrane | Unknown |
| 57 | Protein S100-A7 (S100A7) | SEQ ID NO 57 | NP_002954.2 protein S100-A7 [Homo sapiens] | 12 kDa | Cytoskeleton | Ubiquitous | Cell Membrane | Inflammation |
| 58 | Protein S100-A8 (S100A8) | SEQ ID NO 58 | NP_001306125.1 protein S100-A8 isoform a [Homo sapiens] | 11 kDa | Cytoskeleton | Ubiquitous | Cytoplasm | Synaptogenesis |
| 59 | Protein S100-A9 (S100A9) | SEQ ID NO 59 | NP_002956.1 protein S100-A9 [Homo sapiens] | 11 kDa | Cytoskeleton | Ubiquitous | Cytoplasm | Synaptogenesis |

FIG. 1G

| 60 | Protein SON (SON) | SEQ ID NO 60 | NP_620305.2 protein SON isoform F [Homo sapiens] | 13 kDa | Cytoskeleton | Ubiquitous | Cytoplasm | Synaptogenesis |
| 61 | Protein-tyrosine sulfotransferase 1 (TPST1) | SEQ ID NO 61 | NP_003587.1 protein-tyrosine sulfotransferase 1 [Homo sapiens] | 264 kDa | Gene regulation | Ubiquitous | Nucleus | Neurogenesis |

TABLE 1

| No. | Protein name (Gene name) | Amino acid sequence for detected protein. | Accession number | MW (kDa). | Function. | Tissue/Cell Specificity. | Cell location. | Role in brain repair process. |
|---|---|---|---|---|---|---|---|---|
| 62 | Scaffold attachment factor B1 (SAFB) | SEQ ID NO 62 | NP_001188267.1 scaffold attachment factor B1 isoform 1 [Homo sapiens] | 42 kDa | Metabolism | Ubiquitous | Cytoplasm | Neurogenesis |
| 63 | Serine/threonine-protein kinase TNNI3K (TNNI3K) | SEQ ID NO 63 | NP_057062.1 serine/threonine-protein kinase TNNI3K [Homo sapiens] | 103 kDa | Gene regulation | Ubiquitous | Nucleus | Neurogenesis |
| 64 | Serpin B12 (SERPINB12) | SEQ ID NO 64 | NP_001294857.1 serpin B12 isoform 1 [Homo sapiens] | 93 kDa | Signaling | Cardiac, bone | Nucleus | Vascular repair |
| 65 | Serpin B3 (SERPINB3) | SEQ ID NO 65 | NP_008850.1 serpin B3 [Homo sapiens] | 46 kDa | Proteolysis | Ubiquitous | extracellular | Inflammation |
| 66 | Serpin B4 (SERPINB4) | SEQ ID NO 66 | NP_002965.1 serpin B4 isoform 1 [Homo sapiens] | 45 kDa | Proteolysis | Ubiquitous | extracellular | Inflammation |
| 67 | SLIT-ROBO Rho GTPase-activating protein 1 (SRGAP1) | SEQ ID NO 67 | NP_065813.1 SLIT-ROBO Rho GTPase-activating protein 1 isoform 1 [Homo sapiens] | 45 kDa | Proteolysis | Ubiquitous | extracellular | Inflammation |
| 68 | Serum amyloid A-1 protein (SAA1) | SEQ ID NO 68 | NP_954630.1 serum amyloid A-1 protein preproprotein [Homo sapiens] | 114 kDa | Inflammation | Ubiquitous | Blood | Inflammation |

| 69 | Serum amyloid A-4 protein (SAA4) | SEQ ID NO 69 | NP_006503.2 serum amyloid A-4 protein precursor [Homo sapiens] | 15 kDa | Inflammation | Ubiquitous | Blood | Inflammation |
| 70 | Serum amyloid P-component (APCS) | SEQ ID NO 70 | NP_001630.1 serum amyloid P-component precursor [Homo sapiens] | 25 kDa | Inflammation | Ubiquitous | Blood | Inflammation |

FIG. 1H
CONTINUED

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 71 | Small proline-rich protein 2E (SPRR2) | SEQ ID NO 71 | NP_001019380.2 small proline-rich protein 2E [Homo sapiens] | 124 kDa | Signaling | Neuronal | Nucleus, Cytoplasm | Neurogenesis |
| 72 | Pre-mRNA-splicing factor SYF1 (XAB2) | SEQ ID NO 71 | NP_064581.2 pre-mRNA-splicing factor SYF1 [Homo sapiens] | 8 kDa | Cell adhesion | Epithelial cell layers, Skin | Cell membrane | Unknown |
| 73 | Small subunit processome component 20 homolog (UTP20) | SEQ ID NO 73 | NP_055318.2 small subunit processome component 20 homolog [Homo sapiens] | 318 kDa | Metabolism, proteolysis | Ubiquitous | Cytoplasm | Metabolism |
| 74 | Storkhead-box protein 2 (STOX2) | SEQ ID NO 74 | NP_064610.1 storkhead-box protein 2 [Homo sapiens] | 103 kDa | Gene regulation | Nucleus | Neuron | Neurogenesis |
| 75 | Transforming acidic coiled-coil-containing protein 2 (TACC2) | SEQ ID NO 75 | XP_005269446.1 PREDICTED: transforming acidic coiled-coil-containing protein 2 isoform X1 [Homo sapiens] | 309 kDa | Cell signaling | Ubiquitous | Nucleus, cytoplasm | Metabolism |
| 76 | Transmembrane and TPR repeat-containing protein 3 (TMTC3) | SEQ ID NO 76 | NP_861448.2 transmembrane and TPR repeat-containing protein 3 [Homo sapiens] | 104 kDa | Cell signaling | Ubiquitous | Golgi apparatus | Synaptogenesis |

FIG. 1I

| 77 | Tripartite motif-containing protein 44 (TRIM44) | SEQ ID NO 77 | NP_060053.2 tripartite motif-containing protein 44 [Homo sapiens] | 38 kDa | Cell signaling | Neurons in development | Nucleus | Neurogenesis |
| 78 | Ubiquitin-60S ribosomal protein L40 (UBA52) | SEQ ID NO 78 | NP_003324.1 ubiquitin-60S ribosomal protein L40 isoform 1 precursor [Homo sapiens] | 15 kDa | Gene regulation | Ubiquitous | Nucleus | Metabolism |

FIG. 1I
CONTINUED

TABLE 1

| No. | Protein name (Gene name) | Amino acid sequence for detected protein | Accession number | MW (kDa) | Function | Tissue/Cell Specificity | Cell location | Role in brain repair process |
|---|---|---|---|---|---|---|---|---|
| 79 | von Willebrand factor (VWF) | SEQ ID NO 79 | NP_000543.2 von Willebrandfactor preproprotein [Homo sapiens] | 309 kDa | Cell adhesion | Ubiquitous | Cell membrane | Vascular repair |
| 80 | WD repeat-containing protein 87 (WDR87) | SEQ ID NO 80 | NP_001278017.1 WD repeat-containing protein 87 isoform 1 [Homo sapiens] | 333 kDa | Cell signaling | Ubiquitous | Nucleus, cytoplasm | Neurogenesis |
| 81 | Zinc finger protein 652 (ZNF652) | SEQ ID NO 81 | NP_055712.1 zinc finger protein 652 [Homo sapiens] | 70 kDa | Gene regulation | Blood, Heart | Nucleus | Neurogenesis |

FIG. 1J

PROTEIN BIOMARKER INDICATORS OF NEUROLOGICAL INJURY AND/OR DISEASE AND METHODS OF USE THEREOF

PRIORITY

This application claims priority from U.S. provisional patent application No. 62/587,272, filed on Nov. 16, 2017, which is hereby incorporated by reference in its entirety.

BACKGROUND OF THE INVENTION

An estimated 5 million patients per year are evaluated for head injury in the emergency departments of hospitals and medical facilities in the United States. Most of the patients who present with head injury have unclear clinical symptoms and no evidence of intracranial structural damage, such as intracranial bleeding or hemorrhage, when evaluated by computed tomography (CT) imaging of the head. Such patients may be allowed to leave a medical facility, but may suffer from late-emerging symptoms or secondary injury. These subsequent complications, resulting from the head injury, can include rupture of damaged blood vessels, neurodegeneration that may be long term and insidious, or more subtle neurocognitive and neuromotor deficits that develop over time. The persistence of brain inflammation can be one underlying factor that influences these changes over time, and both the innate immune response (e.g., resident microglial cell activation in the brain and infiltrating neutrophils) and the adaptive immune system (e.g., autoantibodies and against damage-related proteins), can play a role in these processes. Such factors generate a different proteomic profile in a patient.

Thus, objective tests are needed that can quickly identify and triage patients who have high or low risk for neurological injury-related symptoms. Current techniques involving single or multiple biomarkers are not sufficient to aid in determining or recommending treatments, for predicting a patient's clinical course. As described herein, methods, compositions, and kits are provided that offer clinical and medical advantages and improvements for identifying, diagnosing, and assessing neurological injury and/or disease, as well as severity thereof, in individuals (patients). The biomarkers and methods described herein provide detection and treatment benefits for patients having brain injury.

SUMMARY OF THE INVENTION

Methods, compositions, and kits as described herein are provided for detecting, identifying, diagnosing, prognosing, assessing, monitoring and/or treating a neurological injury or a brain injury and involve the use of one or more, or a subset of, newly discovered protein biomarkers that are indicative of neurological or brain injury, such as in a patient having traumatic brain injury (TBI). A subset of the protein biomarkers detected in the described methods may contain fewer than all of the proteins set forth in Table 1 herein. For example, a detectable subset may contain, illustratively, two or more, three or more, four or more, five or more, six or more, seven or more, eight or more, nine or more, ten or more, etc., of the protein biomarkers set forth in Table 1 herein. Table 1 lists protein biomarker Nos. 1-81 along with, among other things, identifiers for function, cell and tissue specificity and role in brain repair process.

The proteins set forth in Tables 1 reflect components that result from injury, damage, or destruction of various types of neurological, neuronal and/or brain cells and tissues during injury, and/or that result from such cells and tissues undergoing repair processes subsequent to neurological, neuronal, or brain cell and tissue injury, insult, or damage. These protein biomarkers thus provide superior indicators of neurological, neuronal, or brain injury in a subject. The protein biomarkers are readily detectable in a sample, e.g., a blood or serum sample obtained from a subject, and offer new and assayable proteins that provide distinctive insights into different aspects of neurological injury or disease, or brain injury detection, diagnosis, assessment and in a patient who is or may be in need, as well as being useful for clinical and research purposes.

In an aspect, a method of detecting protein biomarkers, or peptide biomarkers derived therefrom, indicative of neurological or brain injury in a subject detects whether one or more protein biomarkers as set forth in Table 1, or peptide biomarkers derived therefrom, are present in a biological sample obtained from the subject by using a protein detection assay. In one embodiment, the method includes contacting the sample with one or more antibodies or antigen binding fragments thereof that specifically bind to the one or more protein biomarkers, or peptide biomarkers derived therefrom, and detecting binding of the one or more antibodies or antigen binding fragments thereof to the one or more protein biomarkers, or peptide biomarkers derived therefrom, or detecting the one or more protein biomarkers, or peptide biomarkers derived therefrom, by using mass spectrometry or other techniques known in the art.

In another aspect, a method of diagnosing a neurological or brain injury in a subject detects whether one or more protein biomarkers in a protein biomarker panel, or peptide biomarkers derived therefrom, are present in a biological sample obtained from the subject by contacting the sample with one or more antibodies or antigen binding fragments thereof that specifically bind the one or more protein biomarkers, or peptide biomarkers derived therefrom; measuring the levels of the one or more protein biomarkers, or peptide biomarkers derived therefrom, present in the biological sample relative to the levels of the same proteins, or peptide biomarkers derived therefrom, in a control sample; and diagnoses a neurological or brain injury in the subject when the measured levels of the one or more protein biomarkers, or peptide biomarkers derived therefrom, are increased or decreased in the subject's sample relative to the control levels. In an embodiment of this exemplary method, the control levels are one or more of (i) levels of the one or more protein biomarkers, or peptide biomarkers derived therefrom, in a subject not having a neurological or brain injury; (ii) the levels of the one or more protein biomarkers, or peptide biomarkers derived therefrom, in a subject having a more serious or severe form of the neurological or brain injury; or (iii) the levels of the one or more protein biomarkers, or peptide biomarkers derived therefrom, in a subject having a less serious or mild form of the neurological or brain injury.

In embodiments of the methods of any of the foregoing aspects, the neurological or brain injury is traumatic brain injury (TBI). In some embodiments of the method, the TBI is a mild form of TBI (mTBI).

In yet another aspect, a method of assessing whether a therapy or treatment regimen for a neurological or brain injury is effective in a subject includes (i) measuring the amounts or levels of one or more protein biomarkers in a protein biomarker panel, or peptide biomarkers derived therefrom, in a sample obtained from the subject at a first time point prior to initiation of a therapy or treatment regimen for a neurological or brain injury; (ii) measuring the amounts or levels of the one or more protein biomarkers in the protein biomarker panel, or peptide biomarkers derived therefrom, in a sample obtained from the subject at second time point subsequent to the first time point and after the subject has received the therapy or treatment regimen; and (iii) assessing that the therapy or treatment regimen is effective when the measured levels of the one or more protein biomarkers in the protein biomarker panel, or peptide biomarkers derived therefrom, are decreased or trending to normal levels at the second time point compared with the levels of the one or more protein biomarkers in the protein biomarker panel, or peptide biomarkers derived therefrom, measured at the first time point.

In embodiments of the methods of any of the foregoing aspects, the biological sample obtained from the subject is selected from blood, serum, plasma, cerebrospinal fluid (CSF), saliva, urine, sputum, secretions, or tears. In particular embodiments, the sample is blood, serum, or plasma. In embodiments of the methods of any of the foregoing aspects, the one or more protein biomarkers or peptide biomarkers derived therefrom, or levels thereof are detected or measured by an immunoassay, an immunoblotting method, an immunoprecipitation assay, an immunostaining method, a quantitative assay, a immunofluorescent assay, or a chemiluminescence assay. In particular embodiments, the one or more protein biomarkers or peptide biomarkers derived therefrom, or levels thereof are detected or measured by an immunoassay, or an assay-on-a-chip assay (e.g., a microarray multiplex assay). In embodiments of the methods of any of the foregoing aspects, the immunoassay is an enzyme linked immunosorbent assay (ELISA) using one or more antibodies or antigen binding fragments thereof that specifically bind to the one or more protein biomarkers in a protein biomarker panel, or peptide biomarkers derived therefrom. In a particular embodiment, the ELISA is a mesoscale discovery electro-chemiluminescence assay (MSD-ELISA).

In embodiments of the methods of any of the foregoing aspects, the protein biomarker panel includes a plurality of biomarkers and includes (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from Brain-Derived Neurotrophic Factor (BDNF), Glial Fibrillary Acidic Protein (GFAP), Intracellular Adhesion Molecule 5 (ICAM5), Synuclein Beta (SNCB), Metallothionein 3 (MT3), Neurogranin (NRGN), Neuron Specific Enolase (NSE), and Aldolase C (ALDOC). In embodiments of the methods of any of the foregoing aspects, a peptide derived from the one or more protein biomarkers is detected or measured. In embodiments of the methods of any of the foregoing aspects, the one or more protein biomarkers, (A), includes a subset of the proteins set forth in Table 1. In embodiments of the methods of any of the foregoing aspects, the one or more protein biomarkers, (A), include a plurality of the proteins set forth in Table 1.

In yet another aspect, a method of assessing whether a therapy or treatment regimen for a neurological or brain injury is effective in a subject includes (a) measuring the amounts or levels of one or more autoantibodies that specifically bind to one or more protein biomarkers in a protein biomarker panel, or peptide biomarkers derived therefrom, in a sample obtained from the subject at a first time point prior to initiation of a therapy or treatment regimen for a neurological or brain injury; (b) measuring the amounts or levels of the one or more autoantibodies in a sample obtained from the subject at second time point subsequent to the first time point and after the subject has received the therapy or treatment regimen; and (c) assessing that the therapy or treatment regimen is effective when the measured levels of the one or more autoantibodies are decreased or trending to normal levels at the second time point compared with the levels of the one or more protein biomarkers, or peptide biomarkers derived therefrom, measured at the first time point.

In another aspect, a method of detecting autoantibodies indicative of a neurological or brain injury in a subject includes contacting a biological sample obtained from the patient with one or more protein biomarkers in a protein biomarker panel, or peptide biomarkers derived therefrom; and detecting specific binding of the one or more protein biomarkers or peptides to one or more antibodies or antigen binding fragments thereof in the sample; wherein the detection of binding is indicative of the presence of one or more autoantibodies against the one or more protein biomarkers or peptides thereof in the subject.

In an embodiment of above methods, the neurological or brain injury is traumatic brain injury (TBI). In embodiments of the above methods, the biological sample is selected from blood, serum, plasma, cerebrospinal fluid (CSF), saliva, urine, sputum, secretions, tears, or tissue. In an embodiment of the above methods, the one or more autoantibodies or levels thereof are detected or measured by an immunoassay, an immunoblotting method, an immunoprecipitation assay, an immunostaining method, a quantitative assay, an immunofluorescent assay, or a chemiluminescence assay. In an embodiment of the above methods, the one or more autoantibodies or levels thereof are detected or measured by an immunoassay or a chip assay.

In an embodiment of the methods of any of the foregoing aspects, detection of the one or more protein biomarkers in a protein biomarker panel, or peptide biomarkers derived therefrom, and/or the amounts or levels thereof in a subject's sample provides a determination and identification of biological or biochemical changes occurring in the subject, which reflect post-injury repair processes selected from inflammation, synaptogenesis, neurogenesis, transdifferentiation, neuronal degeneration, demyelination, glial scar formation, angiogenesis, autophagy, necrosis and/or vascular repair.

In another aspect, a composition includes a solid substrate and a plurality of binding agents immobilized on the substrate, wherein each of the binding agents is immobilized at a different, indexable location on the substrate and the binding agents specifically bind to a plurality of protein biomarkers in a protein biomarker panel, or peptide biomarkers derived therefrom, wherein the protein biomarker panel includes (A) a subset of two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC. In an embodiment of the composition, the binding agents are labeled with a detectable moiety, optionally wherein the detectable moiety is selected from the group consisting of luminescent agents, chemiluminescent agents, radioisotopes, colorimetric agents; and enzyme-substrate agents. In another embodiment of the composition, the binding agents include one or more antibodies or antigen-binding fragments thereof.

In another aspect, a kit includes a plurality of biomarker binding agents capable of specifically binding to a plurality of protein biomarkers in a protein biomarker panel, or peptide biomarkers derived therefrom, contained in a biological sample obtained from a human patient suspected of having or at risk of having traumatic brain injury, wherein the protein biomarker panel includes (A) a subset of two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC; and a detecting reagent or a detecting apparatus capable of indicating binding of the binding agents to the one or more proteins or peptides thereof. In an embodiment of the kit, the biological sample is selected from blood, serum, plasma, cerebrospinal fluid (CSF), saliva, urine, sputum, secretions, tears, or tissue.

In particular embodiments of the methods, compositions, or kit of any of the foregoing aspects, the biological sample is a blood, serum, or plasma sample obtained from a human subject.

In an embodiment of the methods, compositions, or kit of any of the foregoing aspects, the peptide derived from the protein biomarker in the protein panel is a post-translationally modified peptide. In some embodiments, the posttranslational modification is citrullination.

In a particular embodiment of the methods, compositions, or kit of any of the foregoing aspects the protein biomarker panel include (B), one or more protein biomarkers selected from BDNF, GFAP, ICAM5, SNCB, MT3, NRGN, NSE, and ALDOC. In another particular embodiment of the methods, compositions, or kit of any of the foregoing aspects, the protein biomarker panel does not include the one or more protein biomarkers from (B).

In the embodiment of the methods, compositions, or kit of any of the foregoing aspects, (A), the subset of protein biomarkers, includes: (i) at least one protein biomarker selected from one or more cell adhesion proteins, one or more cell signaling proteins, a cell toxicity protein, a clotting protein, one or more cytoskeleton proteins, an extracellular matrix protein, a gene expression mediating protein, one or more gene regulation proteins, one or more inflammation proteins, a microtubule trafficking protein, one or more lipid binding proteins, one or more metabolic enzymes, one or more metabolism protein, a protein binding protein, one or more proteolytic proteins, one or more signaling proteins, a structural protein, one or more synapse proteins, and combinations thereof; (ii) at least one protein biomarker found in mammalian cells or tissue, selected from a protein found in astrocytes, one or more proteins found in blood, one or more protein found in blood, heart and liver tissue, one or more proteins found in brain tissue, a protein found in cardiac tissue, a protein found in epithelial tissue, a protein found in interneurons, a protein found in neuroepithelial cells, one or more proteins found in neurons, a protein found in skin tissue, one or more ubiquitous proteins, and combinations thereof; (iii) at least one protein biomarker having a role in a brain repair process selected from one or more apoptosis proteins, one or more inflammation proteins, one or more innate immunity proteins, one or more membrane repair proteins, one or more metabolism proteins, one or more necrosis proteins, one or more neurodegeneration proteins, one or more neurogenesis proteins, one or more synaptogenesis proteins, one or more vascular repair proteins, and combinations thereof; or combinations of (i), (ii), and (iii).

In a particular embodiment of the methods, compositions, or kits of any of the foregoing aspects, the biomarker panel including (A), the subset of protein biomarkers includes one or more cell adhesion proteins are selected from the group consisting of protein Nos. 6, 12, 16, 25, 32, 38, 45, 47, 51, 72, 79, and 49 from Table 1. In another particular embodiment of the methods, compositions, or kits of any of the foregoing aspects, the biomarker panel including (A), the subset of protein biomarkers includes a cell toxicity protein, No 48, from Table 1. 21. In another particular embodiment of the methods, compositions, or kits of any of the foregoing aspects, the biomarker panel including (A), the subset of protein biomarkers includes a clotting protein, No 43, from Table 1. In another particular embodiment of the methods, compositions, or kits of any of the foregoing aspects, the biomarker panel including (A), the subset of protein biomarkers includes one or more cytoskeleton proteins selected from the group consisting of protein Nos. 57, 58, 59, and 60 from Table 1. In another particular embodiment of the methods, compositions, or kits of any of the foregoing aspects, the biomarker panel including (A), the subset of protein biomarkers includes one or more cell signaling proteins selected from the group consisting of protein Nos. 2, 23, 35, 56, 75, 76, 77, and 80 from Table 1. In another particular embodiment of the methods, compositions, or kits of any of the foregoing aspects, the biomarker panel including (A), the subset of protein biomarkers includes a cell toxicity protein, No 48, from Table 1. In another particular embodiment of the methods, compositions, or kits of any of the foregoing aspects, the biomarker panel including (A), the subset of protein biomarkers includes a clotting protein, No 43, from Table 1. In another particular embodiment of the methods, compositions, or kits of any of the foregoing aspects, the biomarker panel including (A), the subset of protein biomarkers includes one or more cytoskeleton proteins selected from the group consisting of protein Nos. 57, 58, 59, and 60 from Table 1. In another particular embodiment of the methods, compositions, or kits of any of the foregoing aspects, the biomarker panel including (A), the subset of protein biomarkers includes an extracellular matrix protein, No. 37, from Table 1. In another particular embodiment of the methods, compositions, or kits of any of the foregoing aspects, the biomarker panel including (A), the subset of protein biomarkers includes a gene expression mediating protein, No. 31, from Table 1. In another particular embodiment of the methods, compositions, or kits of any of the foregoing aspects, the biomarker panel including (A), the subset of protein biomarkers includes one or more gene regulation proteins selected from the group consisting of protein Nos. 7, 15, 44, 46, 53, 54, 61, 63, 74, 78, and 81 from Table 1. In another particular embodiment of the methods, compositions, or kits of any of the foregoing aspects, the biomarker panel including (A), the subset of protein biomarkers includes one or more inflammation proteins selected from the group consisting of protein Nos. 26, 27, 28, 29, 30, 68, 69, 70, and 36 from Table 1. In another particular embodiment of the methods, compositions, or kits of any of the foregoing aspects, the biomarker panel including (A), the subset of protein biomarkers includes a microtubule trafficking protein, No. 13, from Table 1. In another particular embodiment of the methods, compositions, or kits of any of the foregoing aspects, the biomarker panel including (A), the subset of protein biomarkers includes protein No. 5 from Table 1. In another particular embodiment of the methods, compositions, or kits of any of the foregoing aspects, the biomarker panel including (A), the subset of protein biomarkers includes one or more lipid binding proteins selected from the group consisting of protein Nos. 8, 9, 10, and 34 from Table 1. In another particular embodiment of the methods, compositions, or kits of any of the foregoing aspects, the biomarker panel including (A), the subset of protein biomarkers includes one or more metabolic enzymes selected from the group consisting of protein Nos. 4, 11, 14, 21, 39, 40, 41, and 50 from Table 1. In another particular embodiment of the methods, compositions, or kits of any of the foregoing aspects, the biomarker panel including (A), the subset of protein biomarkers includes one or more metabolism proteins selected from protein Nos. 62 and 73 from Table 1. In another particular embodiment of the methods, compositions, or kits of any of the foregoing aspects, the biomarker panel including (A), the subset of protein biomarkers includes a protein binding protein, No. 42, from Table 1. In another particular embodiment of the methods, compositions, or kits of any of the foregoing aspects, the biomarker panel including (A), the subset of protein biomarkers includes one or more proteolytic proteins selected from the group consisting of protein Nos. 3, 22, 24, 33, 52, 55, 65, 66, and 67 from Table 1. In another particular embodiment of the methods, compositions, or kits of any of the foregoing aspects, the biomarker panel including (A), the subset of protein biomarkers includes one or more signaling proteins selected from protein Nos. 64 and 70 from Table 1. In another particular embodiment of the methods, compositions, or kits of any of the foregoing aspects, the biomarker panel including (A), the subset of protein biomarkers includes a structural protein, No. 1 from Table 1. In another particular embodiment of the methods, compositions, or kits of any of the foregoing aspects, the biomarker panel including (A), the subset of protein biomarkers includes one or more synapse proteins selected from the group consisting of protein Nos. 17, 18, 19, and 20 from Table 1.

In another particular embodiment of the methods, compositions, or kits of any of the foregoing aspects, the biomarker panel including (A), the subset of protein biomarkers includes a protein found in astrocytes, No. 49, from Table 1. In another particular embodiment of the methods, compositions, or kits of any of the foregoing aspects, the biomarker panel including (A), the subset of protein biomarkers includes one or more proteins found in blood selected from the group consisting of protein Nos. 8, 9, 10, 26, 27, 28, 29, 30, 34, and 81 from Table 1. In another particular embodiment of the methods, compositions, or kits of any of the foregoing aspects, the biomarker panel including (A), the subset of protein biomarkers includes one or more protein found in blood, heart and liver tissue selected from protein Nos. 14 and 15 from Table 1. In another particular embodiment of the methods, compositions, or kits of any of the foregoing aspects, the biomarker panel including (A), the subset of protein biomarkers includes a protein found in brain tissue, No. 48, from Table 1. In another particular embodiment of the methods, compositions, or kits of any of the foregoing aspects, the biomarker panel including (A), the subset of protein biomarkers includes a protein found in cardiac tissue, No. 64, from Table 1. In another particular embodiment of the methods, compositions, or kits of any of the foregoing aspects, the biomarker panel including (A), the subset of protein biomarkers includes a protein found in epithelial tissue, No. 72, from Table 1. In another particular embodiment of the methods, compositions, or kits of any of the foregoing aspects, the biomarker panel including (A), the subset of protein biomarkers includes proteins selected from the group consisting of protein Nos. 22, 24, and 25 from Table 1. In another particular embodiment of the methods, compositions, or kits of any of the foregoing aspects, the biomarker panel including (A), the subset of protein biomarkers includes a protein found in interneurons, No. 13, from Table 1. In another particular embodiment of the methods, compositions, or kits of any of the foregoing aspects, the biomarker panel including (A), the subset of protein biomarkers includes a protein found in neuroepithelial cells, No. 45, from Table 1. In another particular embodiment of the methods, compositions, or kits of any of the foregoing aspects, the biomarker panel including (A), the subset of protein biomarkers includes one or more proteins found in neurons selected from the group consisting of protein Nos. 74, 35, 12, 17, 18, 19, 71, 51, 77, 7, 31, 32, 38, and 16 from Table 1. In another particular embodiment of the methods, compositions, or kits of any of the foregoing aspects, the biomarker panel including (A), the subset of protein biomarkers includes a protein found in skin tissue, No. 20, from Table 1. In another particular embodiment of the methods, compositions, or kits of any of the foregoing aspects, the biomarker panel including (A), the subset of protein biomarkers includes one or more ubiquitous proteins selected from the group consisting of protein Nos. 1, 2, 3, 4, 6, 11, 23, 33, 36, 37, 39, 40, 41, 42, 43, 44, 46, 47, 50, 52, 53, 54, 55, 56, 57, 58, 59, 60, 61, 62, 63, 65, 66, 67, 68, 69, 70, 73, 75, 76, 78, 79, and 80 from Table 1.

In another particular embodiment of the methods, compositions, or kits of any of the foregoing aspects, the biomarker panel including (A), the subset of protein biomarkers includes at least one protein biomarker with a role in a brain repair process including one or more apoptosis proteins, selected from protein Nos. 22 and 33 from Table 1. In another particular embodiment of the methods, compositions, or kits of any of the foregoing aspects, the biomarker panel including (A), the subset of protein biomarkers includes at least one protein biomarker with a role in a brain repair process including one or more inflammation proteins, selected from the group consisting of protein Nos. 3, 8, 9, 21, 34, 36, 43, 57, 65, 66, 67, 68, 69, and 70 from Table 1. In another particular embodiment of the methods, compositions, or kits of any of the foregoing aspects, the biomarker panel including (A), the subset of protein biomarkers includes at least one protein biomarker with a role in a brain repair process including one or more innate immunity proteins, selected from the group consisting of protein Nos. 27, 28, 29, and 30 from Table 1. In another particular embodiment of the methods, compositions, or kits of any of the foregoing aspects, the biomarker panel including (A), the subset of protein biomarkers includes at least one protein biomarker with a role in a brain repair process including one or more membrane repair proteins, selected protein Nos. 2 and 41 from Table 1. In another particular embodiment of the methods, compositions, or kits of any of the foregoing aspects, the biomarker panel including (A), the subset of protein biomarkers includes at least one protein biomarker with a role in a brain repair process including one or more metabolism proteins, selected from the group consisting of protein Nos. 11, 14, 15, 37, 39, 40, 48, 50, 73, 75, and 78 from Table 1. In another particular embodiment of the methods, compositions, or kits of any of the foregoing aspects, the biomarker panel including (A), the subset of protein biomarkers includes at least one protein biomarker with a role in a brain repair process including one or more necrosis proteins, selected from the group consisting of protein Nos. 24, 49, and 52 from Table 1. In another particular embodiment of the methods, compositions, or kits of any of the foregoing aspects, the biomarker panel including (A), the subset of protein biomarkers includes at least one protein biomarker with a role in a brain repair process including one or more neurodegeneration proteins, selected from the group consisting of protein Nos. 4, 10, and 25 from Table 1. In another particular embodiment of the methods, compositions, or kits of any of the foregoing aspects, the biomarker panel including (A), the subset of protein biomarkers includes at least one protein biomarker with a role in a brain repair process including one or more neurogenesis proteins, selected from the group consisting of protein Nos. 44, 53, 54, 61, 62, 63, 71, 74, 77, 80, and 81 from Table 1. In another particular embodiment of the methods, compositions, or kits of any of the foregoing aspects, the biomarker panel including (A), the subset of protein biomarkers includes at least one protein biomarker with a role in a brain repair process including one or more synaptogenesis proteins, selected from the group consisting of protein Nos. 6, 7, 12, 13, 16, 17, 18, 19, 20, 23, 35, 38, 45, 47, 51, 55, 58, 59, 60, and 76 from Table 1. In another particular embodiment of the methods, compositions, or kits of any of the foregoing aspects, the biomarker panel including (A), the subset of protein biomarkers includes at least one protein biomarker with a role in a brain repair process including one or more vascular repair proteins, selected from the group consisting of protein Nos. 26, 31, 64, and 79 from Table 1.

In yet another particular embodiment of the methods, compositions, or kits of any of the foregoing aspects, the biomarker panel including (A), the subset of protein biomarkers (i) includes a cell adhesion protein, a cell signaling protein, a cell toxicity protein, a clotting protein, a cytoskeleton protein, an extracellular matrix protein, a gene expression mediating protein, a gene regulation protein, an inflammation protein, a microtubule trafficking protein, a lipid binding protein, a metabolic enzyme, a metabolism protein, a protein binding protein, a proteolytic protein, a signaling protein, a structural protein, and a synapse protein. In yet another particular embodiment of the methods, compositions, or kits of any of the foregoing aspects, the biomarker panel including (A), the subset of protein biomarkers (ii) includes a protein found in astrocytes, a protein found in blood, a protein found in blood, heart and liver tissue, a protein found in brain tissue, a protein found in cardiac tissue, a protein found in epithelial tissue, a protein found in interneurons, a protein found in neuroepithelial cells, a protein found in neurons, a protein found in skin tissue, and a ubiquitous protein. In yet another particular embodiment of the methods, compositions, or kits of any of the foregoing aspects, the biomarker panel including (A), the subset of protein biomarkers (iii) includes an apoptosis protein, an inflammation protein, an innate immunity protein, a membrane repair protein, a metabolism protein, a necrosis protein, a neurodegeneration protein, a neurogenesis protein, synaptogenesis protein, and a vascular repair proteins.

In another aspect, methods of treatment for post-TBI outcomes include: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptide biomarkers derived therefrom, in a control sample; stratifying the risk of the patient at one or more time points for post-TBI outcome when the measured levels of the one or more protein biomarkers, or peptide biomarkers derived therefrom, are increased or decreased in the subject's sample relative to the control levels; and if the risk stratification of the patient is high, administering a therapy or an effective amount of a drug specific to the post TBI outcome to treat the patient. In exemplary methods of treatment, the protein biomarker panel includes a plurality of protein biomarkers selected from: (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC. Embodiments of methods of treatment include methods of treatment for post-TBI seizures, post-TBI depression, post-TBI anxiety, post-TBI PTSD, post-TBI sleep disorders, post-TBI headache, post-TBI chronic pain, post-TBI oculomotor deficits, post-TBI attention and cognitive defects, and post-TBI balance and gait problems.

DESCRIPTION OF THE FIGURES

FIGS. 1A-1J presents Table 1, which sets forth the novel protein biomarkers, Nos. 1-81. The protein biomarkers set forth in Table 1 and amino acid sequences in the sequence listing filed herewith, respectively, were discovered in serum samples obtained from patients having traumatic brain injury (TBI) and identified by mass spectroscopy sequencing.

DEFINITIONS

Figure 2:
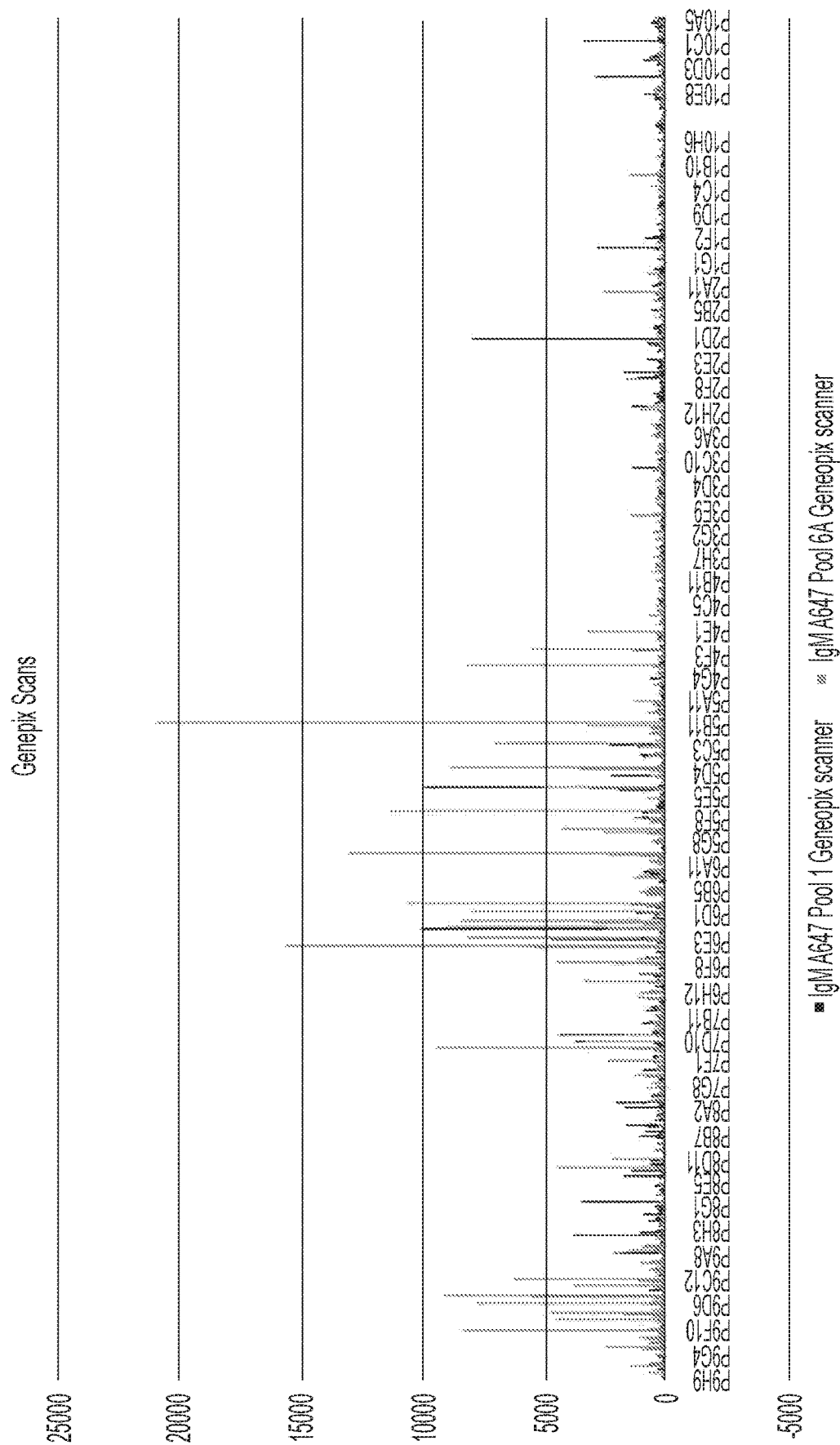
FIG. 2 shows a histogram that graphs the fluorescent signal obtained when individual proteins isolated by two dimensional electrophoresis of serum samples taken from human subjects diagnosed with traumatic brain injury, (TBI), (patient-derived protein arrays), were incubated with serum from a separate cohort of brain-injured patients to allow autoantibody binding, and then probed with anti-human IgM antibody that had a conjugated fluorescent tag (Alexafluor 647). The superimposed orange histograms show the fluorescence intensity of individual proteins from pooled healthy control serum, whereas the blue histograms show the intensity from individual proteins from acutely brain injured individuals. These assays were used to determine which protein fractions showed differential serum protein levels between TBI patients (labelled "IgM A647 Pool 1 Geneopix scanner"—blue histograms) and healthy controls (labelled "IgM A647 Pool 6A Geneopix scanner"—orange histograms). These fractions were subsequently subjected to mass spectroscopy of individual proteins and the sequence of the proteins were identified.

The meaning of certain terms and phrases employed in the specification, examples, and appended claims are provided. The definitions are not meant to be limiting in nature and are intended to provide a clearer understanding of certain aspects and embodiments of the invention.

The term "about" as used herein means, in quantitative terms, plus or minus 5%, or in another embodiment, plus or minus 10%, or in another embodiment, plus or minus 15%, or in another embodiment, plus or minus 20%.

As used herein, the term "antigen" is generally used in reference to any substance that is capable of reacting with an antibody. More specifically, as used herein, the term "antigen" refers to a synthetic peptide, polypeptide, protein or fragment of a polypeptide or protein, or other molecule which elicits an antibody response in a subject, or is recognized and bound by an antibody.

As used herein, the term "autoantibody" or "autoantibodies" refers to an antibody or antibodies produced in an individual, which is/are capable of reacting against an antigenic constituent of the individual's own protein, tissue, or cells (e.g., the antibodies recognize and bind to "self-antigens" or "self-proteins").

As used herein, the term "biomarker" refers to a molecule that is associated either quantitatively or qualitatively with a biological change. Examples of biomarkers include polypeptides, proteins or fragments of a polypeptide or protein; and polynucleotides, such as a gene product, RNA or RNA fragment, or encoding polynucleotides; and other body metabolites. In certain embodiments, a "biomarker" means a compound (e.g., a protein) that is differentially present (i.e., increased or decreased) in a biological sample from a subject or a group consisting of subjects having a first phenotype (e.g., having a disease or condition) as compared to a biological sample from a subject or group consisting of subjects having a second phenotype (e.g., not having the disease or condition or having a less severe version of the disease or condition). A biomarker may be differentially present at any level, but is generally present at a level that is decreased by at least 5%, by at least 10%, by at least 15%, by at least 20%, by at least 25%, by at least 30%, by at least 35%, by at least 40%, by at least 45%, by at least 50%, by at least 55%, by at least 60%, by at least 65%, by at least 70%, by at least 75%, by at least 80%, by at least 85%, by at least 90%, by at least 95%, or by 100% (i.e., absent); or that is increased by at least 5%, by at least 10%, by at least 15%, by at least 20%, by at least 25%, by at least 30%, by at least 35%, by at least 40%, by at least 45%, by at least 50%, by at least 55%, by at least 60%, by at least 65%, by at least 70%, by at least 75%, by at least 80%, by at least 85%, by at least 90%, by at least 95%, by at least 100%, by at least 110%, by at least 120%, by at least 130%, by at least 140%, by at least 150%, or more. Alternatively, the differential presence of a biomarker can be characterized by a-fold change in level including, for example, a level that is decreased by 1.1-fold, at least 1.2-fold, at least 1.3-fold, at least 1.4-fold, at least 1.5-fold, at least 2.0-fold, at least 2.5-fold, at least 3.0-fold, at least 3.5-fold, at least 4.0-fold, at least 5-fold, at least 5.5-fold, at least 6-fold, at least 6.5-fold, at least 7.0-fold, at least 7.5-fold, at least 8.0-fold, at least 9-fold, at least 10-fold, at least 11-fold, at least 12-fold, at least 13-fold, at least 14-fold, at least 15-fold, at least 16-fold, at least 17-fold, at least 18-fold, at least 19-fold, at least 20-fold, at least 25-fold, at least 30-fold, at least 40-fold, or at least 50-fold; or that is increased by 1.1-fold, at least 1.2-fold, at least 1.3-fold, at least 1.4-fold, at least 1.5-fold, at least 2.0-fold, at least 2.5-fold, at least 3.0-fold, at least 3.5-fold, at least 4.0-fold, at least 5-fold, at least 5.5-fold, at least 6-fold, at least 6.5-fold, at least 7.0-fold, at least 7.5-fold, at least 8.0-fold, at least 9-fold, at least 10-fold, at least 11-fold, at least 12-fold, at least 13-fold, at least 14-fold, at least 15-fold, at least 16-fold, at least 17-fold, at least 18-fold, at least 19-fold, at least 20-fold, at least 25-fold, at least 30-fold, at least 40-fold, or at least 50-fold. A biomarker is preferably differentially present at a level that is statistically significant (e.g., a p-value less than 0.05 and/or a q-value of less than 0.10 as determined using, for example, either Welch's T-test or Wilcoxon's rank-sum Test).

The term "one or more of" refers to combinations of various protein biomarkers. The term encompasses 1, 2, 3, 4, 5, 6, 7, 8, 9, 10, 11, 12, 13, 15, 16, 17, 18, 19, 20, 21, 22, 23, 24, 25, 26, 27, 28, 29, 30, 31, 32, 33, 34, 35, 36, 37, 38, 39, 40 . . . to N, where "N" is the total number of protein biomarkers in the particular embodiment. The term also encompasses at least 1, at least 2, at least 3, at least 4, at least 5, at least 6, at least 7, at least 8, at least 9, at least 10, at least 11, at least 12, at least 13, at least 15, 16, 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40 . . . to N. In the biomarker panel of the methods, compositions and kits of the invention, for the one or more biomarkers in (A), N=81. It is understood that the recitation of biomarkers herein includes the phrase "one or more of" the biomarkers and, in particular, includes the "at least 1, at least 2, at least 3" and so forth language in each recited embodiment of a biomarker panel.

The term "biomarker panel" refers to a collection of a plurality of biomarkers grouped together for use in the embodiments of the methods, compositions and kits of the invention. The biomarkers in the panel may be protein biomarkers, or peptide biomarkers derived therefrom. In some embodiments of the methods, compositions or kits of the invention, the protein biomarker panel includes (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC. If the protein biomarker panel contains only one protein from Table 1, then the panel must include (B) one or more protein biomarkers selected from BDNF, GFAP, ICAM5, SNCB, MT3, NRGN, NSE, and ALDOC, so that the panel includes a plurality of biomarkers.

The term "peptide biomarkers derived therefrom" includes the isoforms and/or post-translationally modified forms of any of the foregoing. The invention contemplates the detection, measurement, quantification and/or determination or other analysis of both unmodified and modified (e.g., citrullination or other post-translational modification) proteins/polypeptides/peptides, as well as autoantibodies to any of the foregoing. In certain embodiments, it is understood that reference to the detection, measurement, quantification and/or determination, or other analysis, of a biomarker refers to detection of the protein/polypeptide/peptide (modified and/or unmodified). In other embodiments, reference to the detection, measurement, quantification and/or determination, or other analysis, of a biomarker refers to detection of autoantibodies of the protein/polypeptide/peptide.

"Altered" as used herein can refer to an increase or decrease. An increase is any positive change, e.g., by at least about 5%, 10%, or 20%; by at least about 25%, 50%, 75%, or even by 100%, 200%, 300% or more, including values between the stated percentages. A decrease is a negative change, e.g., a decrease by at least about 5%, 10%, or 20%; by at least about 25%, 50%, 75%; or even an increase by 100%, 200%, 300% or more, including values between the stated percentages.

The term "brain injury" refers to a condition in which the brain (central nervous system or neurological system) is damaged by injury caused by an event. As used herein, an "injury" is an alteration in cellular or molecular integrity, activity, level, robustness, state, or other alteration that is traceable to an event. For example, an injury includes a physical, mechanical, chemical, biological, functional, infectious, or other modulator of cellular or molecular characteristics. An event can include a physical trauma such as a single or repetitive impact (percussive) or a biological abnormality such as a stroke resulting from either blockage or leakage of a blood vessel. An event is optionally an infection by an infectious agent. A person of skill in the art recognizes numerous equivalent events that are encompassed by the terms injury or event.

More specifically, the term "brain injury" refers to a condition that results in central nervous system damage, irrespective of its pathophysiological basis. Among the most frequent origins of a "brain injury" are stroke and traumatic brain injury (TBI).

"Stroke" refers to the destruction of brain tissue as a result of intracerebral hemorrhage or infarction. Stroke is a leading cause of death in the developed world. It may be caused by reduced blood flow and death of tissues in one area of the brain (infarction). Causes of strokes include blood clots that form in the blood vessels in the brain (thrombus) and blood clots or pieces of atherosclerotic plaque or other material that travel to the brain from another location (emboli). Transient ischemic attack (TIA or "mini stroke") is caused by a temporary blockage of blood to the brain, which causes short-term brain dysfunction and is typically resolved within about 24 hours. Bleeding (hemorrhage) within the brain may also cause symptoms that mimic stroke. A "stroke" is classified into hemorrhagic and non-hemorrhagic forms. Examples of hemorrhagic stroke include cerebral hemorrhage, subarachnoid hemorrhage, and intracranial hemorrhage secondary to cerebral arterial malformation, while examples of non-hemorrhagic stroke include cerebral infarction.

A neurological injury, disorder, disease, or condition refers to any injury to the nervous system or central nervous system, or any disorder of the nervous system or central nervous system. Structural, biochemical, or electrical abnormalities in the brain, spinal cord, nerves of the central nervous system, or other nerves (e.g., peripheral nerves) can result in a range of symptoms. Examples of symptoms of a neurological injury include paralysis, muscle weakness, poor coordination, loss of sensation, seizures, confusion, pain and altered levels of consciousness. Neurological injury or disorders may be assessed by neurological examination and may be treated within neurology and clinical neuropsychology medical specialties. Neurological disorders can be categorized according to the primary location affected, the primary type of dysfunction involved, or the primary cause. Other non-limiting examples of neurological diseases and conditions include neuromuscular disease (e.g., neuropathy, amyotrophic lateral sclerosis (ALS), myopathy, muscular dystrophy, myasthenia gravis), movement disorders (e.g., Parkinson's disease, dystonia, Huntington's disease, Benign essential tremor, Tourette syndrome, cerebral palsy, spasicity), multiple sclerosis, epilepsy, headaches, hemifacial spasm, trigeminal neuralgia (TGN), occipital neuralgia, or brain aneurysm. Neurological tumors can occur at many sites throughout the nervous system and may include pituitary adenoma, acoustic neuroma, meningioma, brain tumor, neurofibromatosis (NF). Other neurological conditions or disorders include Alzheimer's disease and dementias. A brain injury is a non-limiting type of neurological injury, disorder, or condition.

The term "brain injury" also refers to subclinical brain injury, spinal cord injury, and anoxic-ischemic brain injury. The term "subclinical brain injury" (SCI) refers to brain injury without overt clinical evidence of brain injury. A lack of clinical evidence of brain injury when brain injury actually exists could result from degree of injury, type of injury, level of consciousness, medications particularly sedation and anesthesia.

The term "traumatic brain injury" or "TBI" refers to traumatic injuries to the brain which occur when physical trauma causes brain damage. For example, TBI can result from a closed head injury or a penetrating head injury. Symptoms of TBI can be mild (even imperceptible at first) and include headache, confusion, visual disturbances, and nausea. Signs of severe TBI include loss of consciousness exceeding six hours, convulsions, dilation of the pupils, and dizziness. TBI is graded as mild (mild TBI or "mTBI") meaning a brief change in mental status or consciousness), moderate, or severe (meaning an extended period of unconsciousness or amnesia after the injury) on the basis of the level of consciousness or Glasgow coma scale (GCS) score after resuscitation. The GCS scores eye opening (spontaneous=4, to speech=3, to pain=3, none=1), motor response (obeys=6, localizes=5, withdraws=4, abnormal flexion=3, extensor response=2, none=1), and verbal response (oriented=5, confused=4, inappropriate=3, incomprehensible=2, none=1). Mild TBI (GCS 13-15) is in most cases a concussion and there is full neurological recovery, although many of these patients have short-term memory and concentration difficulties. In moderate TBI (GCS 9-13) the patient is lethargic or stuporous, and in severe injury (GCS 3-8) the patient is comatose, unable to open his or her eyes or follow commands.

A "non-traumatic brain injury" refers to brain injuries that do not involve ischemia or external mechanical force (e.g., stroke, Alzheimer's disease, Parkinson's disease, Huntington's disease, multiple sclerosis, amyotrophic lateral sclerosis, brain hemorrhage, brain infections, brain tumor, among others).

The term "mild traumatic brain injury (mTBI)" is also commonly known as "concussion" and refers to the occurrence of injury to the head or brain arising from blunt trauma or impact, or forceful motion of the head (acceleration or deceleration forces) causing one or more of the following conditions attributable to head injury: transient confusion, disorientation, or impaired consciousness; dysfunction of memory around the time of injury; or loss of consciousness lasting less than 30 minutes. One or more of the symptoms of mTBI can last a year or more following the initial head or brain injury. While early mTBI symptoms may appear to be mild, they can lead to significant, life-long impairment in an individual's ability to function physically, cognitively and psychologically. While the term "concussion" is used interchangeably with mTBI at times, concussions cover a clinical spectrum and may occur without loss of consciousness. Mild concussion may be present even if there is no external sign of trauma to the head. The spectrum of concussions related to sports injuries are defined by The Quality Standards Subcommittee of the American Academy of Neurology as follows: Grade 1 concussion: transient confusion, no loss of consciousness and duration of mental status abnormalities on examination that resolve in less than 15 minutes Grade 2 concussion: transient confusion, no loss of consciousness, concussion symptoms or mental status abnormalities on examination that last more than 15 minutes; and Grade 3 concussion: any loss of consciousness, either brief (seconds) or prolonged (minutes). (Centers for Disease Control and Prevention).

As used herein, "secondary brain trauma" refers to damage to the brain of a patient post-acute brain injury, i.e., during the secondary injury phase of a TBI.

As used herein, "acute brain injury" refers to the condition of a patient who has suffered a neurological or brain injury and at a relatively short number of hours, such as 1-10 hours, 1-8 hours, 1-5 hours, 2-5 hours, 3-5 hours, 4-5 hours, and the like from the actual time of the injury.

As used herein, "sub-acute brain injury" refers to the condition of a patient who has suffered a neurological or brain injury from about 2-5 days post injury.

As used herein, "chronic brain injury" refers to the condition of a patient who has suffered a neurological or brain injury from about three days post injury until at least 12 months previously, or from about 1-5 months, or about 1-3 months from the actual time of injury, yet continues to present symptoms of brain injury.

A "spinal cord injury" refers to a condition in which the spinal cord receives compression/detrition due to a vertebral fracture or dislocation to cause dysfunction. As used herein, the term "anoxic-ischemic brain injury" refers to deprivation of oxygen supply to brain tissue resulting in compromised brain function and includes cerebral hypoxia. For example, anoxic-ischemic brain injury includes focal cerebral ischemia, global cerebral ischemia, hypoxic hypoxia (i.e., limited oxygen in the environment causes reduced brain function, such as with divers, aviators, mountain climbers, and fire fighters, all of whom are at risk for this kind of cerebral hypoxia), obstructions in the lungs (e.g., hypoxia resulting from choking, strangulation, the crushing of the windpipe).

The term "brain injury biomarker" (BIB), "brain injury protein biomarker", "brain injury biomarker peptide", brain injury biomarker polypeptide," neurological injury biomarker, and the like refer to a protein, including those described herein, that is associated with or indicative of neurological injury or disease and/or brain injury or disease and can be used in methods according to the principles of the invention, e.g., to identify, diagnose and/or detect neurological injury or disease, or brain injury or disease, e.g., mTBI or concussion, in a patient. As described herein, the protein biomarkers include, but are not limited to, the proteins set forth in Table 1, herein.

The term "brain injury biomarkers" also includes the isoforms and/or post-translationally modified forms of any of the foregoing. The invention contemplates the detection, measurement, quantification, determination and the like of both unmodified and modified (e.g., citrullination or other post-translational modification) proteins/polypeptides/peptides, as well as autoantibodies to any of the foregoing. In certain embodiments, it is understood that reference to the detection, measurement, determination, and the like, of a biomarker refers to detection of the protein/polypeptide/peptide (modified and/or unmodified). In other embodiments, reference to the detection, measurement, determination, and the like, of a biomarker refers to detection of autoantibodies of the protein/polypeptide/peptide.

As used herein, the terms "comparing" or "comparison" refers to making an assessment of how the proportion, level or cellular localization of one or more biomarkers in a sample from a patient relates to the proportion, level or cellular localization of the corresponding one or more biomarkers in a standard or control sample. For example, "comparing" may refer to assessing whether the proportion, level, or cellular localization of one or more biomarkers in a sample from a patient is the same as, more or less than, or different from the proportion, level, or cellular localization of the corresponding one or more biomarkers in standard or control sample. More specifically, the term may refer to assessing whether the proportion, level, or cellular localization of one or more biomarkers in a sample from a patient is the same as, more or less than, different from or otherwise corresponds (or not) to the proportion, level, or cellular localization of predefined biomarker levels/ratios that correspond to, for example, a patient having a neurological injury or brain injury, not having a neurological injury or brain injury, is responding to treatment for a neurological injury or brain injury, is not responding to treatment for the neurological injury or brain injury, is/is not likely to respond to a particular treatment for the neurological injury or brain injury, or having/not having another disease or condition. In a specific embodiment, the term "comparing" refers to assessing whether the level of one or more biomarkers of the invention in a sample from a patient is the same as, more or less than, different from or other otherwise corresponds (or not) to levels/ratios of the same biomarkers in a control sample (e.g., predefined levels/ratios that correlate to healthy individuals, to individuals with no neurological injury or brain injury, to individuals with a lesser degree of neurological injury or brain injury, standard brain injury levels/ratios, etc.). In another embodiment, the terms "comparing" or "comparison" refers to making an assessment of how the proportion, level or cellular localization of one or more biomarkers in a sample from a patient relates to the proportion, level or cellular localization of another biomarker in the same sample. For example, a ratio of one biomarker to another from the same patient sample can be compared.

An "isolated polynucleotide" refers to a nucleic acid (e.g., a DNA or RNA) that is free of the genes which, in the naturally-occurring genome of the organism from which the nucleic acid molecule is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule (mRNA) that is transcribed from a DNA molecule, as well as a recombinant DNA that is part of a hybrid gene encoding one or more additional polypeptide sequences.

Nucleic acid molecules (polynucleotides), which encode the protein biomarkers of Table 1 in the present disclosure, include any nucleic acid molecule that encodes the disclosed proteins, or peptides thereof. Such nucleic acid molecules need not be 100% identical to an endogenous nucleic acid sequence, but will typically exhibit substantial identity. For example, a polynucleotide can have at least about 85% or greater nucleotide sequence identity to a polynucleotide that encodes a protein biomarker of Table 1. Polynucleotides having "substantial identity" to an endogenous sequence are typically capable of hybridizing with at least one strand of a double-stranded nucleic acid molecule. Polynucleotides having "substantial identity" to an endogenous sequence are typically capable of hybridizing with at least one strand of a double-stranded nucleic acid molecule. By "hybridize" is meant pairing to form a double-stranded molecule between complementary polynucleotide sequences (e.g., a gene), or portions thereof, under various conditions of stringency.

(See, e.g., Wahl, G. M. and S. L. Berger, 1987, *Methods Enzymol.*, 152:399; Kimmel, A. R., 1987, *Methods Enzymol.*, 152:507).

An "isolated polypeptide" refers to a polypeptide or protein, such as the proteins set forth in Table 1 that has been separated from components that naturally accompany it, or from components that are present during an isolation or purification process. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the disclosure. An isolated polypeptide of the disclosure may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

As used herein, the terms "indicates" or "correlates" (or "indicating" or "correlating," or "indication" or "correlation," depending on the context) in reference to a parameter, e.g., a modulated proportion, level, or cellular localization in a sample from a patient, may mean that the patient is improving, not improving, etc. In specific embodiments, the parameter may include the level of one or more biomarkers as described herein. A particular set or pattern of the amounts of one or more biomarkers may indicate that a patient has improved or worsened.

In other embodiments, a particular set or pattern of the amounts of one or more biomarkers may be correlated to a patient being unaffected (i.e., indicates a patient does not have brain injury). In certain embodiments, "indicating," or "correlating," as used according to the invention, may be by any linear or non-linear method of quantifying the relationship between levels/ratios of biomarkers to a standard, control or comparative value for the assessment of the diagnosis, prediction of a neurological injury, brain injury or progression thereof, assessment of efficacy of clinical treatment, identification of a patient who may respond to a particular treatment regime or pharmaceutical agent, monitoring of the progress of treatment, and in the context of a screening assay, for the identification of a therapeutic for the neurological injury or brain injury.

"Magnetic resonance imaging (MRI)" of the brain is a noninvasive and painless neuroimaging test for detailed visualization and analysis that uses a magnetic field and radio waves to produce detailed images of the brain and the brain stem. Unlike a CAT scan (also called a CT scan; computed axial tomography scan), an MRI scan does not use radiation. In some cases, a dye (contrast dye) or contrast material (e.g., iodine, barium, or gadolinium) is used during the MRI to allow visualization of the brain structures (e.g., blood vessels and tissue) more clearly. For example, the dye may show blood flow and areas of inflammation or edema. In some cases, MRI is 3T MRI.

The terms "patient," "individual," or "subject" are used interchangeably herein, and refer to a mammal, particularly, a human. The patient may have a mild, intermediate or severe disease or condition. The patient may be an individual in need of treatment or in need of diagnosis based on particular symptoms or personal or family history. In some cases, the terms may refer to treatment in experimental animals, in veterinary application, and in the development of animal models for disease, including, but not limited to, rodents including mice, rats, and hamsters; and primates.

The terms "measuring" and "determining" are used interchangeably throughout, and refer to methods which include obtaining or providing a patient sample and/or detecting the level (or amount) of a biomarker(s) in a sample. In one embodiment, the terms refer to obtaining or providing a patient sample and detecting the level of one or more biomarkers in the sample. In another embodiment, the terms "measuring" and "determining" mean detecting the level of one or more biomarkers in a patient sample. The term "measuring" is also used interchangeably throughout with the term "detecting." In certain embodiments, the term is also used interchangeably with the term "quantifying."

The terms "sample," "patient sample," "biological sample," "biologic sample," "biofluid sample," and the like, encompass a variety of sample types obtained from a patient, individual, or subject and can be used in a diagnostic, screening, or monitoring assay. The patient sample may be obtained from a healthy subject or a patient suspected of having or having associated symptoms of neurological injury or brain injury. Moreover, a sample obtained from a patient can be divided, and only a portion may be used for diagnosis. Further, the sample, or a portion thereof, can be stored under conditions to maintain sample for later analysis. The definition of "sample" specifically encompasses blood, serum, plasma, cerebrospinal fluid (CSF) and other liquid samples of biological origin, including, but not limited to, peripheral blood, cord blood, amniotic fluid, tears, urine, saliva, stool, semen, secretions and synovial fluid. A sample also encompasses solid tissue samples, such as a biopsy specimen or cells derived therefrom, or tissue culture cells and the progeny thereof. A tissue or cell sample may be processed (e.g., homogenized, etc.) to produce a suspension or dispersion in liquid form, as discussed below. In a specific embodiment, a sample includes a blood sample. In another embodiment, a sample includes a plasma sample. In yet another embodiment, a serum sample is used. In certain embodiments, a sample includes cerebrospinal fluid.

The definition of "sample" also includes samples that have been manipulated in any way after their procurement, such as by centrifugation, filtration, precipitation, dialysis, chromatography, treatment with reagents, washed, or enriched for certain cell populations. The terms further encompass a clinical sample, and also include cells in culture, cell supernatants, tissue samples, organs, and the like. Samples may also include fresh-frozen and/or formalin-fixed, paraffin-embedded tissue blocks, such as blocks prepared from clinical or pathological biopsies, prepared for pathological analysis or study by immunohistochemistry. A sample may be tested immediately after collection, or it may be tested after storage at 4° C., −20° C., or −80° C. Storage times may be 24 hours, 1 week, 1 month, 1 year, 10 years or up to 30 years, depending on stability of the sample and storage conditions.

Various methodologies of the instant invention include a step that involves comparing a value, level, feature, characteristic, property, etc. to a "suitable control," referred to interchangeably herein as an "appropriate control," a "control sample," a "reference" or simply a "control." A "suitable control," "appropriate control," "control sample," "reference" or a "control" is any control or standard familiar to one of ordinary skill in the art useful for comparison purposes. A "reference level" of a biomarker means a level of the biomarker that is indicative of a particular disease state, phenotype, or lack thereof, as well as combinations of disease states, phenotypes, or lack thereof. A "positive" reference level of a biomarker means a level that is indicative of a particular disease state or phenotype. A "negative"

reference level of a biomarker means a level that is indicative of a lack of a particular disease state or phenotype. For example, a "brain injury-positive reference level" of a biomarker means a level of a biomarker that is indicative of brain injury in a subject, and a "brain injury-negative reference level" of a biomarker means a level of a biomarker that is indicative of no brain injury of in a subject.

A "reference level" of a biomarker may be an absolute or relative amount or concentration of the biomarker, a presence or absence of the biomarker, a range of amount or concentration of the biomarker, a minimum and/or maximum amount or concentration of the biomarker, a mean amount or concentration of the biomarker, and/or a median amount or concentration of the biomarker; and, in addition, "reference levels" of combinations of biomarkers may also be ratios of absolute or relative amounts or concentrations of two or more biomarkers with respect to each other. Appropriate positive and negative reference levels of biomarkers for a particular disease state, phenotype, or lack thereof may be determined by measuring levels of desired biomarkers in one or more appropriate subjects, and such reference levels may be tailored to specific populations of subjects (e.g., a reference level may be age-matched so that comparisons may be made between biomarker levels in samples from subjects of a certain age and reference levels for a particular disease state, phenotype, or lack thereof in a certain age group). Such reference levels may also be tailored to specific techniques that are used to measure levels of biomarkers in biological samples (e.g., ELISA, PCR, LC-MS, GC-MS, etc.), where the levels of biomarkers may differ based on the specific technique that is used.

In one embodiment, a "suitable control" or "appropriate control" is a value, level, feature, characteristic, property, etc., determined in a cell, organ, or patient, e.g., a control or normal cell, organ, or patient, exhibiting, for example, normal traits. For example, the biomarkers of the invention may be assayed for levels/ratios in a sample from an unaffected individual (UI) (e.g., no brain injury) or a normal control individual (NC) (both terms are used interchangeably herein). For example, a "suitable control" or "appropriate control" can be a value, level, feature, characteristic, property, ratio, etc. determined prior to performing a therapy (e.g., brain injury treatment) on a patient or a value, level, feature, characteristic, property, ratio, etc. determined prior to disease development (e.g., a baseline test). In yet another embodiment, a protein level/ratio, transcription rate, mRNA level, translation rate, biological activity, cellular characteristic or property, genotype, phenotype, etc., can be determined prior to, during, or after administering a therapy into a cell, organ, or patient. In a further embodiment, a "suitable control" or "appropriate control" is a predefined value, level, feature, characteristic, property, ratio, etc. A "suitable control" can be a profile or pattern of levels/ratios of one or more biomarkers of the invention that correlates to brain injury, to which a patient sample can be compared. The patient sample can also be compared to a negative control, i.e., a profile that correlates to not having brain injury.

As used herein, the term "predetermined threshold value of expression" of a biomarker refers to the level of expression of the same biomarker (expressed, for example, in ng/ml) in a corresponding control/normal sample or group consisting of control/normal samples obtained from normal, or healthy, subjects, i.e., subject who do not have brain injury. Further, the term "altered level of expression" of a biomarker in a sample refers to a level that is either below or above the predetermined threshold value of expression for the same biomarker and thus encompasses either high (increased) or low (decreased) expression levels. In particular embodiments, the biomarkers described herein are increased or decreased relative to age-matched (and/or sex-matched) controls.

The terms "specifically binds to," "specific for," and related grammatical variants refer to that binding which occurs between such paired species as enzyme/substrate, receptor/agonist, antibody/antigen, aptamer/target, and lectin/carbohydrate which may be mediated by covalent or non-covalent interactions or a combination of covalent and non-covalent interactions. When the interaction of the two species produces a non-covalently bound complex, the binding which occurs is typically electrostatic, hydrogen-bonding, or the result of lipophilic interactions. Accordingly, "specific binding" occurs between a paired species where there is interaction between the two which produces a bound complex having the characteristics of an antibody/antigen or enzyme/substrate interaction. In particular, the specific binding is characterized by the binding of one member of a pair to a particular species and to no other species within the family of compounds to which the corresponding member of the binding member belongs. Thus, for example, an antibody typically binds to a single epitope and to no other epitope within the family of proteins. In some embodiments, specific binding between an antigen and an antibody will have a binding affinity of at least $10^{-6}$ M. In other embodiments, the antigen and antibody will bind with affinities of at least $10^{-7}$M, $10^{-8}$M to $10^{-9}$M, $10^{-10}$ M, $10^{-11}$ M, or $10^{-12}$ M. As used herein, the terms "specific binding" or "specifically binding" when used in reference to the interaction of an antibody and a protein or peptide means that the interaction is dependent upon the presence of a particular structure (i.e., the epitope) on the protein.

As used herein, the terms "binding agent specific for" or "binding agent that specifically binds" refers to an agent that binds to a biomarker and does not significantly bind to unrelated compounds. Examples of binding agents that can be effectively employed in the disclosed methods include, but are not limited to, proteins and antibodies, such as monoclonal or polyclonal antibodies, or antigen-binding fragments thereof. In certain embodiments, a binding agent binds a biomarker (e.g., a polypeptide biomarker) with an affinity constant of, for example, greater than or equal to about $1\times10^{-6}$ M.

By "antibody" is meant any immunoglobulin polypeptide, or fragment thereof, having immunogen or antigen binding ability. As used herein, the terms "antibody fragments", "fragment", or "fragment thereof" refer to a portion of an intact antibody, in particular, an immunogen- or antigen-binding portion of the antibody. Examples of antibody fragments include, but are not limited to, linear antibodies; single-chain antibody molecules; Fc or Fc' peptides, Fab and Fab fragments, and multi-specific antibodies formed from antibody fragments. In most embodiments, the terms also refer to fragments that bind an antigen of a target molecule (e.g., a protein biomarker described herein) and can be referred to as "antigen-binding fragments." As used herein, the term "antibody" is used in reference to any immunoglobulin molecule that reacts with a specific antigen. It is intended that the term encompass any immunoglobulin (e.g., IgG, IgM, IgA, IgE, IgD, etc.) obtained from any source (e.g., humans, rodents, non-human primates, caprines, bovines, equines, ovines, etc.). Specific types/examples of antibodies include polyclonal, monoclonal, humanized, chimeric, human, or otherwise-human-suitable antibodies.

"Antibodies" also includes any fragment or derivative of any of the herein described antibodies that specifically binds the target antigen.

The term "epitope" or "antigenic determinant" are used interchangeably herein and refer to that portion of an antigen capable of being recognized and specifically bound by a particular antibody. When the antigen is a polypeptide, epitopes can be formed both from contiguous amino acids and noncontiguous amino acids juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3, and more usually, at least 5 or 8-10 amino acids in a unique spatial conformation. An antigenic determinant can compete with the intact antigen (i.e., the "immunogen" used to elicit the immune response) for binding to an antibody.

By "an effective amount" is meant the amount of a required to ameliorate the symptoms of a disease relative to an untreated patient. The effective amount of active compound(s) used to practice the invention for therapeutic treatment of brain injury varies depending upon the manner of administration, the age, body weight, and general health of the subject. Ultimately, the attending physician or veterinarian will decide the appropriate amount and dosage regimen. Such amount is referred to as an "effective" amount.

As used herein and in the appended claims, the singular forms "a," "an," and "the" include the plural reference unless the context clearly dictates otherwise. Thus, for example, a reference to a "protein" is a reference to one or more proteins, and includes equivalents thereof known to those skilled in the art and so forth.

Unless defined otherwise, all technical and scientific terms used herein have the same meaning as commonly understood by one of ordinary skill in the art to which this invention belongs. Specific methods, devices, and materials are described, although any methods and materials similar or equivalent to those described herein can be used in the practice or testing of the invention. It is understood that the invention is not limited to the particular methods and components, etc., described herein, as these may vary. It is also to be understood that the terminology used herein is used for the purpose of describing particular embodiments only, and is not intended to limit the scope of the invention.

All publications cited herein are hereby incorporated by reference including all journal articles, books, manuals, published patent applications, and issued patents.

DETAILED DESCRIPTION OF THE INVENTION

The methods, compositions, and kits described herein are based in part on the discovery of new proteins in pooled sera from patients having a neurological injury, such as a brain injury, namely, traumatic brain injury (TBI). The described proteins, or subsets thereof, serve as biomarkers for brain injury and neurodegenerative processes in the brain and spinal cord. Briefly, the proteins were discovered by pooling serum from TBI patients using art-recognized 2D gel electrophoresis (PF2D) protein separation and isolation methods. The separated and resolved proteins were purified and sequenced via mass spectroscopy, thus identifying the new protein biomarkers that are detectable in a patient's sample and that are indicative of neurological or brain injury or disease in a patient undergoing testing. Such a patient may have a neurological injury or disease, such as a brain injury, e.g., TBI, may be suspected of having, or may be at risk of having these conditions.

The identified proteins described herein provide new and advantageous biomarkers that are associated with and/or are indicative of neurological injury or disease, brain injury or disease and/or neurodegenerative processes in the brain and spinal cord of a patient who has, is suspected of having, or is at risk of having the foregoing conditions. These protein biomarkers are presented in Table 1 (FIGS. 1A-1J) and are detected in a biological sample from a patient undergoing testing, evaluation, or analysis using the methods as described herein. Encompassed herein are peptides derived from the amino acid sequences of the proteins of Table 1. Such peptides may be detected in the methods described herein. In embodiments of the methods, the amounts of these detected proteins are increased or decreased in a patient's sample compared to controls, if a patient has a neurological injury such as a brain injury, e.g., TBI. In embodiments, a control is a healthy individual with no neurological injury or disease, or no brain injury or disease, e.g., TBI; or a control is an individual who has a lesser or milder form of a neurological injury or disease, or a brain injury or disease, e.g., TBI; or the control is an individual who has a more serious or severe form of a neurological injury or disease, or a brain injury or disease, e.g., TBI.

In an embodiment, a polynucleotide encoding one or more of the protein biomarkers described herein and presented in Table 1 are detected by the methods described herein.

In an embodiment, autoantibodies directed against one or more of the described protein biomarkers are detected in a biological sample from a patient undergoing testing, evaluation, or analysis using the methods as described herein.

Brain Injury

Traumatic brain injury (TBI) is an injury to the head that involves an acute mechanical event, in which sheer force, blunt force, or linear acceleration or deceleration damages brain tissue. Those having skill in the art appreciate that even individuals who are completely asymptomatic after a head injury can have symptoms or disabilities that develop over time, such as weeks to months after the initial injury. Late emerging deficits in patients can also result from multiple subclinical or sub-concussive head injuries.

The recognition of chronic traumatic encephalopathy (CTE) as a more common long term consequence of concussion or repetitive head injury has further underscored the need for biomarkers that are sensitive to more subtle changes after TBI and for long term changes that are not evident in a patient at the time of injury. The proteins identified and described herein are improved and comprehensive biomarkers, and protein biomarker panels, which are indicative of neurological or brain injury or disease and are informative across the spectrum of injury and recovery. The provision of readily detectable protein biomarkers for TBI identification, diagnosis and outcome is beneficial to both patients and the medical community, because these protein biomarkers are detected by the practice of non-invasive methods in which a biological sample obtained from a patient is assayed as described herein.

For example, in order to follow the course of neural inflammation and subsequent degeneration or repair mechanisms in patients who have or are suspected of having TBI, samples from the patients are examined at several time points after the patient experiences or presents with TBI. The protein biomarker panels, provide biomarkers that are detected in elevated (increased), acutely elevated, or decreased amounts, levels, or concentrations in a patient's sample (e.g., a blood sample from a TBI patient), as well as biomarkers that are involved with chronic degradative processes in the patient. Thus, the methods in which these protein biomarkers are detected allow for determining the evolution of post-TBI responses and for arriving at an accurate molecular and anatomical picture of TBI in a patient across a given time course.

Different types of biomarkers may also reflect the various types of cells that suffer damage in TBI. The biological nature and types of cell damage involved in brain injury such as TBI is as complex and heterogeneous as the brain tissue itself, arguably the most complex tissue in the body. Detection of the described protein biomarkers, subsets thereof, and/or increases or decreases in their amounts, in a patient's sample using the methods described herein allows the determination and identification of changes that occur in an injured patient and that reflect the processes of inflammation, synaptogenesis, glial scar formation, angiogenesis and vascular repair which occur post-injury. In embodiments, different subsets of the protein biomarkers, and/or amounts and alterations thereof, are associated with one or more of these biological features and processes that lead to more or less severe neurological damage or brain injury in an injured patient, such as a TBI patient.

Detection of Biomarkers of Neurological Injury or Disease Detection by Immunoassay In specific embodiments of the methods of the invention, the biomarkers in Table 1, Protein Nos. 1-81, can be detected and/or measured by immunoassay. Immunoassay requires biospecific capture reagents/binding agents, such as antibodies, to capture the biomarkers. Many antibodies are available commercially. Antibodies also can be produced by methods well known in the art, e.g., by immunizing animals with the biomarkers. Biomarkers can be isolated from samples based on their binding characteristics. Alternatively, if the amino acid sequence of a polypeptide biomarker is known, the polypeptide can be synthesized and used to generate antibodies by methods well-known in the art.

Detection methods suitable for use in the described methods involve, without limitation, traditional immunoassays including, for example, sandwich immunoassays including enzyme-linked immunosorbent assays (ELISA) or fluorescence-based immunoassays, immunoblots, Western Blots (WB), as well as other enzyme immunoassays. Multiplex ELISA assays are also suitable for use. Nephelometry is an assay performed in liquid phase, in which antibodies are in solution. The binding of a protein antigen to a specific antibody results in changes in absorbance, a parameter that is measured. In a SELDI-based immunoassay, a biospecific capture reagent for the biomarker is attached to the surface of an MS probe, such as a pre-activated protein chip array. The biomarker is then specifically captured on the biochip through this reagent, and the captured biomarker is detected by mass spectrometry.

In certain embodiments, the expression levels of the biomarkers employed herein are quantified by immunoassay, such as ELISA technology. In specific embodiments, the levels of expression of the biomarkers are determined by contacting the biological sample with antibodies, or antigen binding fragments thereof, that selectively bind to the biomarkers; and detecting binding of the antibodies, or antigen binding fragments thereof, to the biomarkers. In certain embodiments, the binding agents employed in the disclosed methods and compositions are labeled with a detectable moiety.

For example, the level of a biomarker in a sample can be assayed by contacting the biological sample with an antibody, or antigen binding fragment thereof, that selectively binds to the target biomarker (referred to as a capture molecule or antibody or a binding agent), and detecting the binding of the antibody, or antigen-binding fragment thereof, to the biomarker. The detection can be performed using a second antibody to bind to the capture antibody complexed with its target biomarker. A target biomarker can be an entire protein, or a variant or modified form thereof. Kits for the detection of biomarkers as described herein can include pre-coated strip plates, biotinylated secondary antibody, standards, controls, buffers, streptavidin-horse radish peroxidase (HRP), tetramethyl benzidine (TMB), stop reagents, and detailed instructions for carrying out the tests including performing standards.

Embodiments of the invention also provide methods for identifying, detecting, or diagnosing brain injury, e.g., mTBI or concussion, in a subject, wherein the protein biomarkers, or levels, amounts, or concentrations thereof, are detected in a sample obtained from a patient or subject. For example, in one embodiment, methods are provided that include: (a) contacting a biological sample obtained from the subject with a plurality of binding agents that selectively bind to a plurality of the protein biomarkers disclosed herein in Table 1 for a period of time sufficient to form binding agent-biomarker complexes; and (b) detecting binding of the binding agents to the plurality of biomarkers in the sample. In an embodiment, detection is by immunoassay or mass spectrometry or other suitable detection assay or system.

In an embodiment, the levels, amounts, or concentrations of the protein biomarkers, or the level of expression of the protein biomarkers from protein biomarker panel, in the biological sample is determined. In addition to the biomarkers in Table, 1, the biomarker panel may include one or more previously known biomarkers for brain injury. In an embodiment, a plurality of the biomarkers from protein biomarker panel includes (A) one or more, two or more, three or more, four or more, five or more, six or more, seven or more, eight or more, nine or more, ten or more, and the like, or all, or a subset of the proteins presented in Table 1, and optionally (B) one or more protein biomarkers selected from BDNF, GFAP, ICAM5, SNCB, MT3, NRGN, NSE, and ALDOC. International Patent Application Publication No. WO 2018/005791 describes methods, compositions and kits useful in the diagnosis, prognosis and/or assessment of brain injuries and risk for brain injuries, such as hemorrhage, are based upon detection of certain biomarkers including BDNF, GFAP, ICAM5, SNCB, MT3, and NSE. U.S. Pat. No. 9,746,481, describes panels of biomarkers useful in diagnosing brain injuries, which include the biomarkers NRGN, MT3 and GFAP, among others. International Patent Application Publication No. WO 2016/179426 describes methods and kits for detecting or monitoring TBI using ALDOC.

The levels, amounts, or concentrations of the biomarkers, or the levels of expression of the biomarkers, or plurality of biomarkers in the protein biomarker panel, in the patient's sample can be compared with predetermined threshold values. By way of example, the levels of expression of at least one of the plurality of polypeptide biomarkers in the panel which are above or below the predetermined threshold values indicates, for example, a neurological injury or brain injury in the subject. Examples of binding agents that can be effectively employed in such methods include, but are not limited to, antibodies or antigen-binding fragments thereof, aptamers, lectins and the like. Such binding agents may include single chain antibodies and camelid antibodies and may be recombinantly produced.

In a further aspect, embodiments of the invention provide compositions that can be employed in the disclosed methods. In certain embodiments, such compositions include a solid substrate and a plurality of binding agents immobilized on the substrate, wherein each of the binding agents is immobilized at a different, indexable, location on the substrate and the binding agents selectively bind to a plurality of biomarkers in a protein biomarker panel, wherein the panel includes (A) one or more, two or more, three or more, four or more, five or more, six or more, seven or more, eight or more, nine or more, ten or more, and the like, or all, or a subset of the proteins presented in Table 1, and optionally (B) one or more protein biomarkers selected from BDNF, GFAP, ICAM5, SNCB, MT3, NRGN, NSE, and ALDOC. In a specific embodiment, the locations are pre-determined. In one embodiment, the binding agents selectively bind to a plurality of biomarkers of the proteins presented in Table 1 described herein. Binding agents that can be employed in such compositions include, but are not limited to, antibodies, or antigen-binding fragments thereof, aptamers, lectins and the like.

In a related aspect, methods for assessing brain injury, e.g., mTBI or concussion, in a subject are provided, such methods including: (a) contacting a biological sample obtained from the subject with a composition disclosed herein for a period of time sufficient to form binding agent-polypeptide biomarker complexes; (b) detecting binding of the plurality of binding agents to the plurality of polypeptide biomarkers in the protein biomarker panel, thereby determining the levels of expression of the plurality of polypeptide biomarkers in the biological sample; and (c) comparing the levels of expression of the plurality of polypeptide biomarkers in the biological sample with pre-determined threshold values, wherein levels of expression of at least one of the plurality of polypeptide biomarkers above or below the predetermined threshold values indicates brain injury status in the subject.

In yet another aspect, embodiments of the invention provide compositions including a solid substrate and a plurality of polypeptide biomarkers in a protein biomarker panel disclosed herein immobilized on the substrate, wherein each of the polypeptide biomarkers is immobilized at a different, indexable, location on the substrate. The protein biomarker panel includes a plurality of biomarkers selected from: (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC.

Although antibodies are useful because of their extensive characterization, any other suitable agent (e.g., a ligand molecule, a peptide, an aptamer, or a small organic molecule) that specifically binds a biomarker of the invention may be optionally used in place of the antibody in the above described immunoassays. For example, an aptamer that specifically binds a biomarker and/or one or more of its breakdown products might be used. Aptamers are nucleic acid-based molecules that bind specific ligands. Methods for making aptamers with a particular binding specificity are known as detailed in U.S. Pat. Nos. 5,475,096; 5,670,637; 5,696,249; 5,270,163; 5,707,796; 5,595,877; 5,660,985; 5,567,588; 5,683,867; 5,637,459; and 6,011,020.

In specific embodiments, the assay performed on the biological sample can include contacting the biological sample with one or more capture agents (e.g., antibodies, peptides, aptamer, etc., combinations thereof) to form a biomarker capture agent complex. The complexes can then be detected and/or quantified. A subject can then be identified as having brain injury based on a comparison of the detected/quantified/measured levels of biomarkers to one or more reference controls as described herein.

In one method, a first, or capture, binding agent, such as an antibody that specifically binds the biomarker of interest, is immobilized on a suitable solid phase substrate or carrier. The test biological sample is then contacted with the capture antibody and incubated for a desired period of time. After washing to remove unbound material, a second, detection, antibody that binds to a different, non-overlapping, epitope on the biomarker (or to the bound capture antibody) is then used to detect binding of the polypeptide biomarker to the capture antibody. The detection antibody is preferably conjugated, either directly or indirectly, to a detectable moiety. Examples of detectable moieties that can be employed in such methods include, but are not limited to, chemiluminescent and luminescent agents; fluorophores such as fluorescein, rhodamine and eosin; radioisotopes; colorimetric agents; and enzyme-substrate labels, such as biotin.

In another embodiment, the assay is a competitive binding assay, wherein labeled biomarker is used in place of the labeled detection antibody, and the labeled biomarker and any unlabeled biomarker present in the test sample compete for binding to the capture antibody. The amount of biomarker bound to the capture antibody can be determined based on the proportion of labeled biomarker detected.

Solid phase substrates, or carriers, that can be effectively employed in such assays are well known to those of skill in the art and include, for example, 96 well microtiter plates, glass, paper, and microporous membranes constructed, for example, of nitrocellulose, nylon, polyvinylidene difluoride, polyester, cellulose acetate, mixed cellulose esters and polycarbonate. Suitable microporous membranes include, for example, those described in U.S. Patent Application Publication No. U.S. 2010/0093557 A1. Methods for the automation of immunoassays are well known in the art and include, for example, those described in U.S. Pat. Nos. 5,885,530, 4,981,785, 6,159,750 and 5,358,691.

The presence of several different polypeptide biomarkers in a test sample can be detected simultaneously using a multiplex assay, such as a multiplex ELISA. Multiplex assays offer the advantages of high throughput, a small volume of sample being required, and the ability to detect different proteins across a board dynamic range of concentrations.

In certain embodiments, such methods employ an array, wherein multiple binding agents (for example capture antibodies) specific for multiple biomarkers are immobilized on a substrate, such as a membrane, with each capture agent being positioned at a specific, pre-determined, location on the substrate. Methods for performing assays employing such arrays include those described, for example, in U.S. Patent Application Publication Nos. US2010/0093557A1 and US2010/0190656A1, the disclosures of which are incorporated by reference herein.

Multiplex arrays in several different formats based on the utilization of, for example, flow cytometry, chemiluminescence or electron-chemiluminescence technology, can be used. Flow cytometric multiplex arrays, also known as bead-based multiplex arrays, include the Cytometric Bead Array (CBA) system from BD Biosciences (Bedford, Mass.)

and multi-analyte profiling (xMAP®) technology from Luminex Corp. (Austin, Tex.), both of which employ bead sets which are distinguishable by flow cytometry. Each bead set is coated with a specific capture antibody. Fluorescence or streptavidin-labeled detection antibodies bind to specific capture antibody-biomarker complexes formed on the bead set. Multiple biomarkers can be recognized and measured by differences in the bead sets, with chromogenic or fluorogenic emissions being detected using flow cytometric analysis.

In an alternative format, a multiplex ELISA from Quansys Biosciences (Logan, Utah) coats multiple specific capture antibodies at multiple spots (one antibody at one spot) in the same well on a 96-well microtiter plate. Chemiluminescence technology is then used to detect multiple biomarkers at the corresponding spots on the plate.

Detection by Mass Spectrometry

In one aspect, the described biomarkers may be detected by mass spectrometry, a method that employs a mass spectrometer to detect gas phase ions. Examples of mass spectrometers are time-of-flight, magnetic sector, quadrupole filter, ion trap, ion cyclotron resonance, Orbitrap, hybrids or combinations of the foregoing, and the like.

In particular embodiments, the biomarkers of the invention are detected using selected reaction monitoring (SRM) mass spectrometry techniques. Selected reaction monitoring (SRM) is a non-scanning mass spectrometry technique, performed on triple quadrupole-like instruments and in which collision-induced dissociation is used as a means to increase selectivity. In SRM experiments two mass analyzers are used as static mass filters, to monitor a particular fragment ion of a selected precursor ion. The specific pair of mass-over-charge (m/z) values associated to the precursor and fragment ions selected is referred to as a "transition" and can be written as parent m/z→fragment m/z (e.g. 673.5→534.3). Unlike common MS based proteomics, no mass spectra are recorded in a SRM analysis. Instead, the detector acts as counting device for the ions matching the selected transition thereby returning an intensity distribution over time. Multiple SRM transitions can be measured within the same experiment on the chromatographic time scale by rapidly toggling between the different precursor/fragment pairs (sometimes called multiple reaction monitoring, MRM). Typically, the triple quadrupole instrument cycles through a series of transitions and records the signal of each transition as a function of the elution time. The method allows for additional selectivity by monitoring the chromatographic co-elution of multiple transitions for a given analyte. The terms SRM/MRM are occasionally used also to describe experiments conducted in mass spectrometers other than triple quadrupoles (e.g. in trapping instruments) where upon fragmentation of a specific precursor ion a narrow mass range is scanned in MS2 mode, centered on a fragment ion specific to the precursor of interest or in general in experiments where fragmentation in the collision cell is used as a means to increase selectivity. In this application the terms SRM and MRM or also SRM/MRM can be used interchangeably, since they both refer to the same mass spectrometer operating principle. As a matter of clarity, the term MRM is used throughout the text, but the term includes both SRM and MRM, as well as any analogous technique, such as e.g. highly-selective reaction monitoring, hSRM, LC-SRM or any other SRM/MRM-like or SRM/MRM-mimicking approaches performed on any type of mass spectrometer and/or, in which the peptides are fragmented using any other fragmentation method such as e.g. CAD (collision-activated dissociation (also known as CID or collision-induced dissociation), HCD (higher energy CID), ECD (electron capture dissociation), PD (photodissociation) or ETD (electron transfer dissociation).

In another specific embodiment, the mass spectrometric method includes matrix assisted laser desorption/ionization time-of-flight (MALDI-TOF MS or MALDI-TOF). In another embodiment, method includes MALDI-TOF tandem mass spectrometry (MALDI-TOF MS/MS). In yet another embodiment, mass spectrometry can be combined with another appropriate method(s) as may be contemplated by one of ordinary skill in the art. For example, MALDI-TOF can be utilized with trypsin digestion and tandem mass spectrometry as described herein.

In an alternative embodiment, the mass spectrometric technique includes surface enhanced laser desorption and ionization or "SELDI," as described, for example, in U.S. Pat. Nos. 6,225,047 and 5,719,060. Briefly, SELDI refers to a method of desorption/ionization gas phase ion spectrometry (e.g. mass spectrometry) in which an analyte (here, one or more of the biomarkers) is captured on the surface of a SELDI mass spectrometry probe. There are several versions of SELDI that may be utilized including, but not limited to, Affinity Capture Mass Spectrometry (also called Surface-Enhanced Affinity Capture (SEAC)), and Surface-Enhanced Neat Desorption (SEND) which involves the use of probes including energy absorbing molecules that are chemically bound to the probe surface (SEND probe). Another SELDI method is called Surface-Enhanced Photolabile Attachment and Release (SEPAR), which involves the use of probes having moieties attached to the surface that can covalently bind an analyte, and then release the analyte through breaking a photolabile bond in the moiety after exposure to light, e.g., to laser light (see, U.S. Pat. No. 5,719,060). SEPAR and other forms of SELDI are readily adapted to detecting a biomarker or biomarker panel, pursuant to the invention.

In another mass spectrometry method, the biomarkers can be first captured on a chromatographic resin having chromatographic properties that bind the biomarkers. For example, one could capture the biomarkers on a cation exchange resin, such as CM Ceramic HyperD F resin, wash the resin, elute the biomarkers and detect by MALDI. Alternatively, this method could be preceded by fractionating the sample on an anion exchange resin before application to the cation exchange resin. In another alternative, one could fractionate on an anion exchange resin and detect by MALDI directly. In yet another method, one could capture the biomarkers on an immuno-chromatographic resin that includes antibodies that bind the biomarkers, wash the resin to remove unbound material, elute the biomarkers from the resin and detect the eluted biomarkers by MALDI or by SELDI.

Detection by Electrochemiluminescent Assay

In several embodiments, the described protein biomarkers may be detected by means of an electrochemiluminescent assay developed by Meso Scale Discovery (Gaithersburg, MD). Electrochemiluminescence detection uses labels that emit light when electrochemically stimulated. Background signals are minimal because the stimulation mechanism (electricity) is decoupled from the signal (light). Labels are stable, non-radioactive and offer a choice of convenient coupling chemistries. They emit light at ~620 nm, eliminating problems with color quenching. See U.S. Pat. Nos. 7,497,997; 7,491,540; 7,288,410; 7,036,946; 7,052,861; 6,977,722; 6,919,173; 6,673,533; 6,413,783; 6,362,011; 6,319,670; 6,207,369; 6,140,045; 6,090,545; and 5,866,434. See also U.S. Patent Applications Publication No. 2009/0170121; No. 2009/006339; No. 2009/0065357; No. 2006/0172340; No. 2006/0019319; No. 2005/0142033; No. 2005/

0052646; No. 2004/0022677; No. 2003/0124572; No. 2003/0113713; No. 2003/0003460; No. 2002/0137234; No. 2002/0086335; and No. 2001/0021534.

Other Methods for Detecting Biomarkers

The protein biomarkers can be detected by other suitable methods. Detection paradigms that can be employed to this end include optical methods, electrochemical methods (voltammetry and amperometry techniques), atomic force microscopy, and radio frequency methods, e.g., multipolar resonance spectroscopy. Illustrative of optical methods, in addition to microscopy, both confocal and non-confocal, are detection of fluorescence, luminescence, chemiluminescence, absorbance, reflectance, transmittance, and birefringence or refractive index (e.g., surface plasmon resonance, ellipsometry, a resonant mirror method, a grating coupler waveguide method or interferometry).

In another embodiment, a sample, such as a sample containing the protein biomarkers described herein, may also be analyzed by means of a biochip. Biochips generally include solid substrates and have a generally planar surface, to which a capture reagent (also called an adsorbent or affinity reagent) is attached. Frequently, the surface of a biochip includes a plurality of addressable locations, each of which has the capture reagent bound there. Protein biochips are biochips adapted for the capture of polypeptides. Many protein biochips are described in the art. These include, for example, protein biochips produced by Ciphergen Biosystems, Inc. (Fremont, CA.), Invitrogen Corp. (Carlsbad, CA), Affymetrix, Inc. (Fremont, CA), Zyomyx (Hayward, CA), R&D Systems, Inc. (Minneapolis, MN), Biacore (Uppsala, Sweden) and Procognia (Berkshire, UK). Examples of such protein biochips are described in the following patents or published patent applications: U.S. Pat. Nos. 6,537,749; 6,329,209; 6,225,047; 5,242,828; PCT International Publication No. WO 2000/56934; and PCT International Publication No. WO 03/048768.

In a particular embodiment, a microarray chip may be utilized. More specifically, the chip includes a small wafer that carries a collection of binding agents bound to its surface in an orderly pattern, each binding agent occupying a specific position on the chip. The set of binding agents specifically bind to each of the one or more one or more of the biomarkers described herein. In particular embodiments, a few microliters of a biological sample, e.g., a blood, serum, or plasma sample, are dropped on the chip array. Protein biomarkers present in the tested specimen bind to the binding agents which specifically recognize and target the proteins. The subtype and amount of a bound biomarker can be detected and quantified using, for example, a fluorescently-labeled secondary, subtype-specific antibody. In particular embodiments, an optical reader is used for bound biomarker detection and quantification. Thus, a system can include a chip array and an optical reader. In other embodiments, a chip is provided.

Other assays useful for detection of the plurality of protein biomarkers in the protein biomarker panel, or peptide biomarkers derived therefrom, in a biological sample from a patient, e.g., a TBI patient, include single-molecule arrays (SIMOA™), (e.g., as provided by Quanterix, Lexington, MA), which are bead-based detection assays, in which antibody capture molecules are attached to the surface of paramagnetic beads that are capable of detecting thousands of single protein molecules simultaneously and use the same reagents as are used in conventional ELISA assays described herein. Femtomolar (fg/mL) concentrations of proteins can be measured in a SIMOA bead-based immunoassay, which involves arrays of femtoliter-sized reaction chambers that can isolate and detect single protein molecules. Because the array volumes are significantly smaller than those of a conventional ELISA, a rapid increase of fluorescent product is generated if a labeled protein is present.

2-Dimensional Gel Electrophoresis

Two-dimensional electrophoresis (2-D electrophoresis) is a powerful and widely-used biochemical separation technique for the analysis of complex protein mixtures extracted from cells, tissues, or other biological samples. As is appreciated by the skilled practitioner, this technique separates proteins according to two independent properties in two discrete steps: The first dimension step is isoelectric focusing (IEF), which separates proteins according to their isoelectric points (pI). The second dimension step is SDS-polyacrylamide gel electrophoresis (SDS-PAGE), which separates proteins according to their molecular weights (MW). The separated proteins are delineated as spots on a two-dimensional array.

Each spot on the resulting two-dimensional array corresponds to a single protein in a sample. Thousands of different proteins can be separated, and information such as the pI, apparent molecular weight (MW), e.g., in kDa, and the amount of each protein can be obtained. 2-D electrophoresis is a particularly useful as biochemical separation technique tool that may be integral to other developments in separation techniques, image analysis, and protein characterization.

Proteomics, which refers to the systematic separation, identification, and quantification of many proteins simultaneously from a single sample, relies on 2-D electrophoresis and its ability to separate thousands of proteins simultaneously. 2-D electrophoresis can also be used to detect post- and co-translational modifications of protein molecules, which cannot be predicted from the genomic sequence. 2-D electrophoresis is applicable for the analysis of cell differentiation, detection of disease markers in research, drug discovery research, cancer research, purity checks, and microscale protein purification.

2-D Gel Electrophoresis Sample Preparation

For optimal 2-D electrophoresis results, samples must have the right composition for IEF, which means they must be in a solution that does not affect the pI of the proteins to be separated. Accordingly, the samples should not include impurities, especially ionic impurities. Sample preparation can be improved by using specific products to clean-up the samples and provide optimal sample buffers for gel electrophoresis. Streaking resulting from nonspecific oxidation of thiol groups on proteins during 2-D electrophoresis may be addressed by utilizing specific reagents that reduce or eliminate streaking between spots in the gel, especially in the pH range 7 to 11. Such reagents also simplify the spot pattern by reducing the number of spots caused by protein oxidation.

Spot Processing

Gel spots (protein spots) of interest can be picked and analyzed by mass spectrometry (MS) to identify the corresponding proteins. The procedure of picking and digesting spots can be performed manually or semi-automatically by manual transfer of gels and microplates between instruments, or automatically using an integrated workstation. For example, an Ettan Spot Picker is designed to reproducibly spot protein samples and matrix on multiple MALDI MS targets for subsequent analysis by mass spectrometry. An Ettan Digester is an example of a versatile instrument designed to perform in-gel digestion of proteins captured in 2-D gel electrophoresis spots.

2-D Fluorescence Difference Gel Electrophoresis (2-D DIGE)

2-D DIGE is a variant of two-dimensional gel electrophoresis in which an internal standard may be included so that all samples—even those run on different gels—can easily be compared and accurately quantified. An internal standard can virtually eliminate experimental gel-to-gel variation and avoid a need to run technical replicates to confirm differences in protein abundance. 2-D DIGE allows increased throughput and significantly reduced analysis time and cost, dependable results with far fewer 2-D gels (multiplexing two samples per gel with internal standards) and the detection of true differences in protein expression with extremely high statistical confidence.

Briefly, 2-D DIGE is performed by labeling protein samples and internal standard with different fluorescent molecules, such as CyDye DIGE Fluors (GE Healthcare Life Sciences, Piscataway, NJ). The internal standard and one or two samples are run on each gel. Using an internal standard and running multiple samples on the same gel results in fewer gels being run and cost savings. The internal standard is made by pooling all samples in an experiment, and is run on every 2-D DIGE gel. This means that there is a standard for every spot on the gel, and that all gels within the same experiment are quantitatively linked. The internal standard virtually eliminates gel-to-gel variation such that technical replicates are not necessary. A protein sample is first labeled with fluorophores. In contrast to conventional 2D gel electrophoresis in which proteins are post-stained, the protein labeling step in 2-D DIGE is performed before electrophoresis using fluorescent molecules, such as CyDye DIGE Fluors. The first and second dimension electrophoresis steps are performed in a manner similar to that of traditional 2-D electrophoresis, for example using an IEF system, IPG strips, and an electrophoresis system. Image analysis of 2-D DIGE gels is performed with a biomolecular imager that detects multiplex fluorescence, for example, as Typhoon FLA 9500. Analysis (GE Healthcare Life Sciences, Piscataway, NJ) is performed using DeCyder 2-D Differential Analysis Software, optimized for 2-D DIGE.

Autoantibodies

Provided herein are methods for detecting, determining, identifying, measuring, or quantifying, unmodified and modified, e.g., post-translationally modified, citrullinated, glycosylated, etc., proteins in the biomarker panels described herein, as well as autoantibodies to any of the foregoing in a sample obtained from a patient having, suspected of having, or at risk of having a neurological injury or a brain injury. Such autoantibodies directed against a plurality of proteins in a protein biomarker panel, or peptide biomarkers derived therefrom, may be of different immunoglobulin classes and subclasses, e.g., IgM, IgG, IgG1, IgG2a, IgG2b, IgG3, IgG4, etc.). Without wishing to be bound by theory, autoantibodies of the IgM class, or a predominance thereof, that are directed against a plurality of proteins in the protein biomarker panel, or peptide biomarkers derived therefrom, and that are detected in a patient's sample may indicate an early or acute stage of a neurological or brain injury, as this class of antibodies develops early in the immune response. Autoantibodies of the IgG class, or a predominance thereof, detected in a patient's sample may indicate a later or chronic stage of a neurological or brain injury, as this class of antibodies can reflect a sustained or memory immune response.

The determination of the presence of autoantibodies, or of an autoantibody profile, in a patient can be used as a surrogate measurement of the state of the patient prior to brain injury. In addition, the determination of the levels of circulating protein detected at a time after a neurological or brain injury, e.g., a short or a long time period after injury, can be used as a surrogate measurement of the nature or degree of injury. Algorithms that combine the information about the state of the patient prior to injury and the nature or degree of the injury can be used in order to determine how a patient will fare or the outcome of a patient's injury or disease.

The detection of the presence of autoantibodies against protein biomarkers as antigens, as well as the determination of an autoantibody profile, in a subject can be performed, for example, using a platform in which the antigens, e.g., a plurality of proteins in a protein biomarker panel, or peptide biomarkers derived therefrom, are bound to a solid surface or substrate. The surface or substrate is contacted with a sample containing the autoantibodies, which specifically bind to the antigen (e.g., a plurality of proteins in a protein biomarker panel, or peptide biomarkers derived therefrom), and the autoantibodies are detected with a tagged or labeled secondary antibody (e.g., a labeled IgM or IgG antibody) which is detectable. Autoantibody detection can be achieved using, for example, an immunoassay, such as an ELISA format, which includes one or more capture antigens (proteins) and detection antibody(ies).

The platforms used for autoantibody and protein antigen detection may be independent (e.g., iCHIP for autoantibody, MSD ELISA for protein antigens, or any relevant ELISA based platform) or may be combined into a single platform to simultaneously measure both circulating autoantibodies and protein antigens in a sample. By way of example, such dual detection can be accomplished by printing an iCHIP with both the relevant protein antigens and protein antigen-specific capture antibodies (or binding molecules); contacting a subject's sample, e.g., serum, with the printed surface such that circulating autoantibodies bind to the surface bound protein antigens, and circulating protein antigens bind to the surface bound capture antibodies (or binding molecules). A cocktail or mixture of secondary antibodies and detection antibodies can be used for detection of autoantibodies and protein antigens in a sample. In the case where there is a need to measure autoantibodies to the same protein antigen that informs about a disease state or condition, these measurements can we done in two separate chambers. The data from multiple tests can be combined for the purpose of an algorithmic analysis to determine, diagnose, or predict the status of the patient and/or the patient's outcome.

In an embodiment, methods are provided for detecting or diagnosing neurological injury or brain injury in a patient by detecting autoantibodies to a plurality of proteins in a protein biomarker panel, or peptide biomarkers derived therefrom. In one embodiment, autoantibodies to a plurality of protein biomarkers are detected, for example, autoantibodies directed against more than one, more than two, more than three, more than four, more than five, and the like, of the proteins in the protein biomarker panel are detected in a sample. In another embodiment, autoantibodies directed against a subset of the proteins in the protein biomarker panel is detected.

In an embodiment, a method is provided for detecting the presence of autoantibodies that bind to one or more of the protein biomarkers, or a plurality of the protein biomarkers, a protein biomarker panel in a biological sample obtained from the patient. In an embodiment, the detection of the autoantibodies can diagnose, identify, evaluate, or assess a neurological injury or a brain injury, e.g., TBI, in the patient. In an embodiment, the autoantibodies are detected by contacting a biological sample obtained from the patient with one or more of the protein biomarkers of the biomarker panel, or a bindable peptide derived therefrom, and detecting the binding of the protein biomarker or peptide with a labeled or otherwise detectable antibody specific for the protein or peptide, wherein the detection of binding is indicative of the presence of autoantibodies against the protein biomarker or peptide thereof in the patient. In an embodiment, the amount of autoantibodies that specifically bind to the protein or peptide biomarkers can be compared with those in a control subject not having a neurological injury or a brain injury, or to those in a control subject having a lesser or milder form of the neurological injury or brain injury, which assists in determining the status of the neurological injury or the brain injury in the patient undergoing testing.

In another embodiment, a method for assessing the effectiveness of a neurological injury or brain injury therapy or treatment regimen in a patient, in which (a) a baseline level of autoantibodies that bind to a plurality of protein biomarkers in a biomarker panel is established in the subject, by detecting the presence of the autoantibodies in the patient at a first time point prior to therapy or treatment of the patient for the neurological injury or brain injury; (b) detecting (monitoring) the levels of autoantibodies that bind to a plurality of protein biomarkers in a biomarker panel, at a second time point and, optionally at additional time points, after initiation of the therapy or treatment regimen; and (c) comparing the detected levels of the autoantibodies that bind to the plurality of protein biomarkers in a biomarker panel at the second (and/or subsequent time points) to the baseline level of autoantibodies determined at the first time point as described for (a) above. A decrease in the level of autoantibodies detected at the second and/or subsequent time points is indicative of the effectiveness of the neurological injury or brain injury therapy or treatment regimen in the patient. In an embodiment, one or more peptide biomarkers derived from the protein biomarkers in the protein biomarker panel that are bindable by autoantibodies in the sample are detected.

In a further embodiment, a method for qualifying neurological injury or brain injury status, or degree thereof, in a patient is provided, in which the method involves (a) detecting autoantibodies that bind to a plurality of protein biomarkers in a biomarker panel in a biological sample obtained from a patient; (b) measuring the levels of the autoantibodies that bind to the a plurality of protein biomarkers in a biomarker panel in the patient's sample; and (c) comparing the measured levels of the autoantibodies in (b) with levels of autoantibodies in controls, such as samples from subjects having different neurological injury or brain injury status, e.g., no injury, or mild or lesser degrees of injury, so as to qualify the neurological injury or brain injury status, or degree thereof, in the patient. In various embodiments of the method, the neurological or brain injury status involves one or more of the risk of neurological or brain injury, the development of neurological or brain injury, the presence or absence of neurological or brain injury, the stage of neurological or brain injury, the subtype of neurological or brain injury, the prognosis for the patient, and the effectiveness of treatment of neurological or brain injury.

In embodiments of any of the foregoing methods, the binding of autoantibodies to the one or more protein biomarkers, or to peptides thereof, is detected by enzyme-linked immunosorbent assay (ELISA), immunoprecipitation, or immunoblotting. In certain embodiments, the detected protein is one from a plurality of protein biomarkers in a protein biomarker panel, or a subset of the proteins, or a bindable peptide derived from the proteins in the protein biomarker panel.

Protein Biomarker Panels

The described protein biomarkers can be used in panels of several biomarkers in screening, identification, detection, determinative, or diagnostic methods to screen, identify, detect, determine, evaluate, assess and/or qualify brain injury, TBI, or other types of brain injury in an individual (patient). In particular embodiments of the methods, compositions or kits of the invention, the protein biomarker panel includes a plurality of biomarkers and includes (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC.

In some embodiments of the methods, compositions, or kit of any of the foregoing aspects the protein biomarker panel includes (B), one or more protein biomarkers selected from BDNF, GFAP, ICAM5, SNCB, MT3, NRGN, NSE, and ALDOC. In other embodiments, the protein biomarker panel does not include the one or more protein biomarkers from (B). It is understood that if the protein biomarker panel contains only one protein biomarker (A) from protein Nos. 1-81 from Table 1, then the panel must include (B) one or more protein biomarkers selected from BDNF, GFAP, ICAM5, SNCB, MT3, NRGN, NSE, and ALDOC, so that the panel includes a plurality of biomarkers.

In an embodiment of the methods, compositions, or kit of any of the foregoing aspects, the protein biomarker panel includes (A), the subset of protein biomarkers selected from protein Nos. 1-81 from Table 1, including: (i) at least one protein biomarker selected from one or more cell adhesion proteins, one or more cell signaling proteins, a cell toxicity protein, a clotting protein, one or more cytoskeleton proteins, an extracellular matrix protein, a gene expression mediating protein, one or more gene regulation proteins, one or more inflammation proteins, a microtubule trafficking protein, one or more lipid binding proteins, one or more metabolic enzymes, one or more metabolism protein, a protein binding protein, one or more proteolytic proteins, one or more signaling proteins, a structural protein, one or more synapse proteins, and combinations thereof; (ii) at least one protein biomarker found in mammalian cells or tissue, selected from a protein found in astrocytes, one or more proteins found in blood, one or more protein found in blood, heart and liver tissue, one or more proteins found in brain tissue, a protein found in cardiac tissue, a protein found in epithelial tissue, a protein found in interneurons, a protein found in neuroepithelial cells, one or more proteins found in neurons, a protein found in skin tissue, one or more ubiquitous proteins, and combinations thereof; (iii) at least one protein biomarker with a role in a brain repair process selected from one or more apoptosis proteins, one or more inflammation proteins, one or more innate immunity proteins, one or more membrane repair proteins, one or more metabolism proteins, one or more necrosis proteins, one or more neurodegeneration proteins, one or more neurogenesis proteins, one or more synaptogenesis proteins, one or more vascular repair proteins, and combinations thereof; or (iv) combinations of (i), (ii), and (iii). The protein biomarker panels described above for use in the exemplary methods, compositions and kits of the invention optionally include (B) one or more protein biomarkers selected from BDNF, GFAP, ICAM5, SNCB, MT3, NRGN, NSE, and ALDOC. The functions, cell and tissue types and roles in brain repair processes are known in the art. The term "ubiquitous" refers to proteins found in multiple tissues and cells throughout the body.

In some embodiments of the methods, compositions, or kits of the invention, exemplary protein biomarker panels including a plurality of biomarker proteins and optionally including (B) one or more protein biomarkers selected from BDNF, GFAP, ICAM5, SNCB, MT3, NRGN, NSE, and ALDOC, include one of more of the following biomarkers or groups of biomarkers:

one or more cell adhesion proteins selected from the group consisting of protein Nos. 6, 12, 16, 25, 32, 38, 45, 47, 51, 72, 79, and 49 from Table 1;
  one or more cell signaling proteins selected from the group consisting of protein Nos. 2, 23, 35, 56, 75, 76, 77, and 80 from Table 1;
  a cell toxicity protein, No. 48, from Table 1;
  a clotting protein, No. 43, from Table 1;
  one or more cytoskeleton proteins selected from the group consisting of protein Nos. 57, 58, 59, and 60 from Table 1;
  an extracellular matrix protein, No. 37, from Table 1;
  a gene expression mediating protein, No. 31, from Table 1;
  one or more gene regulation proteins selected from the group consisting of protein Nos. 7, 15, 44, 46, 53, 54, 61, 63, 74, 78, and 81 from Table 1;
  one or more inflammation proteins selected from the group consisting of protein Nos. 26, 27, 28, 29, 30, 68, 69, 70, and 36 from Table 1;
  a microtubule trafficking protein, No. 13, from Table 1;
  protein No. 5 from Table 1;
  one or more lipid binding proteins selected from the group consisting of protein Nos. 8, 9, 10, and 34 from Table 1;
  one or more metabolic enzymes selected from the group consisting of protein Nos. 4, 11, 14, 21, 39, 40, 41, and 50 from Table 1;
  one or more metabolism proteins selected from protein Nos. 62 and 73 from Table 1;
  a protein binding protein, No. 42, from Table 1;
  one or more proteolytic proteins selected from the group consisting of protein Nos. 3, 22, 24, 33, 52, 55, 65, 66, and 67 from Table 1;
  one or more signaling proteins selected from protein Nos. 64 and 70 from Table 1;
  a structural protein, No. 1, from Table 1;
  one or more synapse proteins selected from the group consisting of protein Nos. 17, 18, 19, and 20 from Table 1;
  a protein found in astrocytes, No. 49, from Table 1;
  one or more proteins found in blood selected from the group consisting of protein Nos. 8, 9, 10, 26, 27, 28, 29, 30, 34, and 81 from Table 1;
  one or more protein found in blood, heart and liver tissue selected from protein Nos. 14 and 15 from Table 1;
  a protein found in brain tissue, No. 48, from Table 1;
  a protein found in cardiac tissue, No. 64, from Table 1;
  a protein found in epithelial tissue, No. 72, from Table 1;
  protein Nos. 22, 24, and 25 from Table 1;
  a protein found in interneurons, No. 13, from Table 1;
  a protein found in neuroepithelial cells, No. 45, from Table 1;
  one or more proteins found in neurons selected from the group consisting of protein Nos. 74, 35, 12, 17, 18, 19, 71, 51, 77, 7, 31, 32, 38, and 16 from Table 1;
  a protein found in skin tissue, No. 20, from Table 1;
  one or more ubiquitous proteins selected from the group consisting of protein Nos. 1, 2, 3, 4, 6, 11, 23, 33, 36, 37, 39, 40, 41, 42, 43, 44, 46, 47, 50, 52, 53, 54, 55, 56, 57, 58, 59, 60, 61, 62, 63, 65, 66, 67, 68, 69, 70, 73, 75, 76, 78, 79, and 80 from Table 1;
  one or more apoptosis proteins with a role in the brain repair process, selected from protein Nos. 22 and 33 from Table 1;
  one or more inflammation proteins with a role in the brain repair process, selected from the group consisting of protein Nos. 3, 8, 9, 21, 34, 36, 43, 57, 65, 66, 67, 68, 69, and 70 from Table 1;
  one or more innate immunity proteins with a role in the brain repair process, selected from the group consisting of protein Nos. 27, 28, 29, and 30 from Table 1;
  one or more membrane repair proteins with a role in the brain repair process, selected protein Nos. 2 and 41 from Table 1;
  one or more metabolism proteins with a role in the brain repair process, selected from the group consisting of protein Nos. 11, 14, 15, 37, 39, 40, 48, 50, 73, 75, and 78 from Table 1;
  one or more necrosis proteins with a role in the brain repair process, selected from the group consisting of protein Nos. 24, 49, and 52 from Table 1;
  one or more neurodegeneration proteins with a role in the brain repair process, selected from the group consisting of protein Nos. 4, 10, and 25 from Table 1;
  one or more neurogenesis proteins with a role in the brain repair process, selected from the group consisting of protein Nos. 44, 53, 54, 61, 62, 63, 71, 74, 77, 80, and 81 from Table 1;
  one or more synaptogenesis proteins with a role in the brain repair process, selected from the group consisting of protein Nos. 6, 7, 12, 13, 16, 17, 18, 19, 20, 23, 35, 38, 45, 47, 51, 55, 58, 59, 60, and 76 from Table 1; and
  one or more vascular repair proteins with a role in the brain repair process, selected from the group consisting of protein Nos. 26, 31, 64, and 79 from Table 1. Exemplary protein biomarker panels also include combinations of one or more of the above.

In some embodiments of the methods, compositions, or kits of the invention, exemplary protein biomarker panels including a plurality of biomarker proteins and optionally including (B) one or more protein biomarkers selected from BDNF, GFAP, ICAM5, SNCB, MT3, NRGN, NSE, and ALDOC, include one of more of the following biomarkers or groups of biomarkers:

one or more cell adhesion proteins selected from the group consisting of protein Nos. 12, 16, 25, 38, 51, 79, and 49 from Table 1;
  one or more cell signaling proteins selected from the group consisting of protein Nos. 2, 35, 75, 76, 77, and 80 from Table 1;
  a cell toxicity protein, No. 48, from Table 1;
  a clotting protein, No. 43, from Table 1;
  a gene expression mediating protein, No. 31, from Table 1;
  one or more gene regulation proteins selected from the group consisting of protein Nos. 7, 53, 54, 61, and 74 from Table 1;

one or more inflammation proteins selected from the group consisting of protein Nos. 26, 27, 28, 29, 30, and 36 from Table 1;
one or more lipid binding proteins selected from the group consisting of protein Nos. 10, and 34 from Table 1;
one or more metabolic enzymes selected from the group consisting of protein Nos. 39, 40, 41, and 50 from Table 1;
a metabolism protein, No. 73, from Table 1;
one or more proteolytic proteins selected from the group consisting of protein Nos. 22, 24, and 33 from Table 1;
a signaling protein, No. 71, from Table 1;
a synapse protein, No. 17, from Table 1;
a protein found in astrocytes, No. 49, from Table 1;
one or more proteins found in blood selected from the group consisting of protein Nos. 10, 27, 28, 29, 30, and 34, from Table 1;
a protein found in brain tissue, No. 48, from Table 1;
one or more proteins found in neurons selected from the group consisting of protein Nos. 74, 35, 12, 17, 71, 51, 77, 7, 31, 38, and 16 from Table 1;
a protein found in skin tissue, No. 20, from Table 1;
one or more ubiquitous proteins selected from the group consisting of protein Nos. 2, 33, 36, 39, 40, 41, 43, 50, 53, 54, 61, 73, 75, 76, and 79 from Table 1;
one or more apoptosis proteins with a role in the brain repair process, selected from protein Nos. 22 and 33 from Table 1;
one or more inflammation proteins with a role in the brain repair process, selected from the group consisting of protein Nos. 34, 36, and 43 from Table 1;
one or more innate immunity proteins with a role in the brain repair process, selected from the group consisting of protein Nos. 27, 28, 29, and 30 from Table 1;
one or more membrane repair proteins with a role in the brain repair process, selected protein Nos. 2 and 41 from Table 1;
one or more metabolism proteins with a role in the brain repair process, selected from the group consisting of protein Nos. 39, 40, 48, 50, 73, and 75 from Table 1;
one or more necrosis proteins with a role in the brain repair process, selected from the group consisting of protein Nos. 24 and 49 from Table 1;
one or more neurodegeneration proteins with a role in the brain repair process, selected from the group consisting of protein Nos. 10 and 25 from Table 1;
one or more neurogenesis proteins with a role in the brain repair process, selected from the group consisting of protein Nos. 53, 54, 61, 71, 74, and 77 from Table 1;
one or more synaptogenesis proteins with a role in the brain repair process, selected from the group consisting of protein Nos. 7, 12, 13, 16, 17, 35, 38, 51, 55, 58, 59, 60, and 76 from Table 1; and
one or more vascular repair proteins with a role in the brain repair process, selected from the group consisting of protein Nos. 31 and 79 from Table 1. Exemplary protein biomarker panels also include combinations of one or more of the above.

In yet another particular embodiment of the methods, compositions, or kits of any of the foregoing aspects, the protein biomarker panel includes (A), the subset of protein biomarkers (i) includes a cell adhesion protein, a cell signaling protein, a cell toxicity protein, a clotting protein, a cytoskeleton protein, an extracellular matrix protein, a gene expression mediating protein, a gene regulation protein, an inflammation protein, a microtubule trafficking protein, a lipid binding protein, a metabolic enzyme, a metabolism protein, a protein binding protein, a proteolytic protein, a signaling protein, a structural protein, and a synapse protein. In yet another particular embodiment of the methods, compositions, or kits of any of the foregoing aspects, the biomarker panel includes (A), the subset of protein biomarkers (ii) includes a protein found in astrocytes, a protein found in blood, a protein found in blood, heart and liver tissue, a protein found in brain tissue, a protein found in cardiac tissue, a protein found in epithelial tissue, a protein found in interneurons, a protein found in neuroepithelial cells, a protein found in neurons, a protein found in skin tissue, and a ubiquitous protein. In yet another particular embodiment of the methods, compositions, or kits of any of the foregoing aspects, the biomarker panel includes (A), the subset of protein biomarkers (iii) includes an apoptosis protein, an inflammation protein, an innate immunity protein, a membrane repair protein, a metabolism protein, a necrosis protein, a neurodegeneration protein, a neurogenesis protein, synaptogenesis protein, and a vascular repair proteins.

In yet another particular embodiment of the methods, compositions, or kits of any of the foregoing aspects, the protein biomarker panel includes a plurality of biomarker proteins selected from one or more of the following: one or more cell adhesion proteins selected from the group consisting of NAV3, MEG10, LAMA3, CELGR1, CLUS, ANXA2, LEG7, ASTN2, VWF, ICAM5, and SPR2E; one or more cell signaling proteins selected from the group consisting of TMTC3, TRI44, and FRMPD4; one or more cell toxicity proteins selected from the group consisting of MT1X and MT3; a clotting protein, HRG; one or more cytoskeleton proteins selected from the group consisting of S100A7, S100A8, S100A9, S100A11, and GFAP; an extracellular matrix protein FBN1; one or more gene regulation proteins selected from the group consisting of A2GL, STOX2, CWC22, SYF1, SON, ZN652, AP3B2 and KMT2A; one or more inflammation proteins selected from the group consisting of FABP5, CAH1, S100A11, SAA1, SAA4, SAMP, HRG, FETB, CO41, CO9, CFAH and FHR1; a microtubule trafficking protein, ABCA2; one or more lipid binding proteins selected from the group consisting of APOA1 and APOB; one or more metabolic enzymes selected from the group consisting of CAH1, ARGI1, GGCT, GPX3, PGRP2, TACC2, NSE and ALDOC; a metabolism protein, FBN1; one or more proteolytic proteins selected from the group consisting of CASPE, ADAM8, and A1AT; a signaling protein TRI44; a structural protein; and a synapse protein, KCNMA1.

In yet another particular embodiment of the methods, compositions, or kits of any of the foregoing aspects, the protein biomarker panel includes a plurality of biomarker proteins selected from one or more of the following: one or more proteins found in astrocytes selected from the group consisting of ASTN2, MEG10, GFAP, and ALDOC; a protein found in blood, APOE; one or more proteins found in blood, heart and liver tissue selected from the group consisting of BD1L1 and NR1H1; a protein found in brain tissue, MT1X; a protein found in cardiac tissue FABP5; a protein found in epithelial tissue, SPR2E; a protein found in interneurons, ABCA2; one or more proteins found in neuroepithelial cells selected from the group consisting of DSC1, LEG7, ASTN2, FRMPD4 and KCNMA1; and one or more proteins found in neurons selected from the group consisting of AP3B2, CELGR1, NAV3, STOX2, TRI44, OR SRGAP1.

In yet another particular embodiment of the methods, compositions, or kits of any of the foregoing aspects, the protein biomarker panel includes a plurality of biomarker proteins selected from one or more of the following: one or more apoptosis proteins selected from the group consisting of CASPE, MEG10 and CATD, one or more inflammation proteins selected from the group consisting of FABP5, CAH1, S100A11, SAA1, SAA4, SAMP, HRG and FETB; one or more innate immunity proteins selected from the group consisting of CO41, CO9, CFAH, and FHR1; one or more membrane repair proteins selected from the group consisting of PLCH1 and PG12A; one or more metabolism proteins selected from the group consisting of ARGI1, GGCT, GPX3, PGRP2, TACC2, and ALDOC; one or more necrosis proteins selected from the group consisting of KLKB1, CATD, and MEG10, one or more neurodegeneration proteins selected from the group consisting of APOE, CLUS, and ENOA, one or more neurogenesis proteins selected from the group consisting of SRGAP1, STOX2, and TRI44; one or more synaptogenesis proteins selected from the group consisting of TMTC3, PCSK5, NAV3, FRMPD4, and LEG7; and one or more vascular repair proteins selected from the group consisting of VWF, TNI3K, FA12, and CUL7.

The phrase "brain injury status" includes any distinguishable manifestation of brain injury, as the case may be, e.g., TBI, mTBI or concussion, including not having brain injury. For example, brain injury status includes, without limitation, brain injury or non-injury in a patient, the stage or severity of brain injury, the progress of brain injury (e.g., progress of brain injury over time), or the effectiveness or response to treatment of brain injury (e.g., clinical follow up and surveillance of brain injury after treatment). Based on this status, further procedures may be indicated, including additional diagnostic tests or therapeutic procedures or regimens.

The power of a diagnostic test to correctly predict status is commonly measured as the sensitivity of the assay, the specificity of the assay or the area under a receiver operated characteristic ("ROC") curve. Sensitivity is the percentage of true positives that are predicted by a test to be positive, while specificity is the percentage of true negatives that are predicted by a test to be negative. An ROC curve provides the sensitivity of a test as a function of 1-specificity. The greater the area under the ROC curve, the more powerful the predictive value of the test. Other useful measures of the utility of a test are positive predictive value and negative predictive value. Positive predictive value is the percentage of people who test positive that are actually positive. Negative predictive value is the percentage of people who test negative that are actually negative.

In particular embodiments, the biomarker panels of the invention may show a statistical difference in different brain injury statuses of at least $p<0.05$, $p<10^{-2}$, $p<10^{-3}$, $p<10^{-4}$ or $p<10^{-5}$. Diagnostic tests that use these biomarkers may show an ROC of at least 0.6, at least about 0.7, at least about 0.8, or at least about 0.9.

The protein biomarkers can be differentially present in UI (NC or non-brain injury) and brain injury, and, therefore, are useful in aiding in the determination of brain injury status. In certain embodiments, the biomarkers are measured in a patient sample using the methods described herein and compared, for example, to predefined biomarker levels/ratios and correlated to brain injury status. In particular embodiments, the measurement(s) may then be compared with a relevant diagnostic amount(s), cut-off(s), or multivariate model scores that distinguish a positive brain injury status from a negative brain injury status. The diagnostic amount(s) represents a measured amount of a biomarker(s) above which or below which a patient is classified as having a particular brain injury status. For example, if the biomarker(s) is/are up-regulated compared to normal, then a measured amount(s) above (or greater than) the diagnostic cutoff(s) provides an assessment of brain injury status. Alternatively, if the biomarker(s) is/are down-regulated, then a measured amount(s) at or below the diagnostic cutoff(s) provides an assessment of brain injury status. As is well understood in the art, by adjusting the particular diagnostic cut-off(s) used in an assay, one can increase sensitivity or specificity of the diagnostic assay depending on the preference of the diagnostician. In particular embodiments, the particular diagnostic cut-off can be determined, for example, by measuring the amount of biomarkers in a statistically significant number of samples from patients with the different brain injury statuses, and drawing the cut-off to suit the desired levels of specificity and sensitivity.

In other embodiments, the relative or normalized amounts of biomarkers to each other are useful in aiding in the determination of brain injury status. In certain embodiments, the biomarker ratios are indicative of diagnosis. In other embodiments, a biomarker ratio can be compared to another biomarker ratio in the same sample or to a set of biomarker ratios from a control or reference sample.

Furthermore, in certain embodiments, the values measured for markers of a biomarker panel are mathematically combined and the combined value is correlated to the underlying diagnostic question. Biomarker values may be combined by any appropriate state of the art mathematical method. Mathematical methods useful for correlating a marker combination to a brain injury status employ methods like discriminant analysis (DA) (e.g., linear-, quadratic-, regularized-DA), Discriminant Functional Analysis (DFA), Kernel Methods (e.g., SVM), Multidimensional Scaling (MDS), Nonparametric Methods (e.g., k-Nearest-Neighbor Classifiers), PLS (Partial Least Squares), Tree-Based Methods (e.g., Logic Regression, CART, Random Forest Methods, Boosting/Bagging Methods), Generalized Linear Models (e.g., Logistic Regression), Principal Components based Methods (e.g., SIMCA), Generalized Additive Models, Fuzzy Logic based Methods, Neural Networks and Genetic Algorithms based Methods. In one embodiment, the method used in correlating a biomarker combination of the invention, e.g. to assess brain injury, is selected from DA (e.g., Linear-, Quadratic-, Regularized Discriminant Analysis), DFA, Kernel Methods (e.g., SVM), MDS, Nonparametric Methods (e.g., k-Nearest-Neighbor Classifiers), PLS (Partial Least Squares), Tree-Based Methods (e.g., Logic Regression, CART, Random Forest Methods, Boosting Methods), or Generalized Linear Models (e.g., Logistic Regression), and Principal Components Analysis. Details relating to these statistical methods are found in the following references: Ruczinski et al., 12 J. OF COMPUTATIONAL AND GRAPHICAL STATISTICS 475-511 (2003); Friedman, J. H., 84 J. OF THE AMERICAN STATISTICAL ASSOCIATION 165-75 (1989); Hastie, Trevor, Tibshirani, Robert, Friedman, Jerome, The Elements of Statistical Learning, Springer Series in Statistics (2001); Breiman, L., Friedman, J. H., Olshen, R. A., Stone, C. J. Classification and regression trees, California: Wadsworth (1984); Breiman, L., 45 MACHINE LEARNING 5-32 (2001); Pepe, M. S., The Statistical Evaluation of Medical Tests for Classification and Prediction, Oxford Statistical Science Series, 28 (2003); and Duda, R. O., Hart, P. E., Stork, D. G., Pattern Classification, Wiley Interscience, 2nd Edition (2001).

Determining Risk of Brain Injury

In a specific embodiment, methods are provided for determining the risk of brain injury, such as TBI, in a patient. Biomarker percentages, ratios, amounts or patterns are characteristic of various risk states, e.g., high, medium or low. The risk of brain injury is determined by measuring the relevant biomarkers in a protein biomarker panel, and then either submitting them to a classification algorithm or comparing them with a reference amount, i.e., a predefined level or pattern of biomarkers that is associated with the particular risk level.

Determining Severity of Brain Injury

In other embodiments, methods are provided for determining the severity of brain injury, e.g., TBI, mTBI, in a patient. Each grade or stage of brain injury likely has a characteristic level of a biomarker or relative levels/ratios of a set of biomarkers (a pattern or ratio). The severity of brain injury is determined by measuring the relevant biomarkers and then either submitting them to a classification algorithm or comparing them with a reference amount, i.e., a predefined level or pattern of biomarkers that is associated with the particular stage. In embodiments, severity of brain injury, e.g., TBI, is further determined by performing neuroimaging analysis to detect more serious or severe damage or insult, such as a change in vascular permeability, such as, for example, blood vessel leakage or intracranial hemorrhage (ICH). Neuroimaging analysis, e.g., using contrast MRI, allows for the detection and visualization of injury such as bleeding, hemorrhage, or other insult or damage to the integrity to the brain or its blood-brain barrier.

Determining Brain Injury Prognosis

In one embodiment, methods are provided for determining the course of brain injury, e.g., TBI, mTBI or concussion, in a patient, e.g., a patient who has experienced repetitive injury. Brain injury course refers to changes in brain injury status over time, including brain injury progression (worsening) and brain injury regression (improvement). Over time, the levels, amounts, or relative levels or amounts (e.g., the pattern or ratio) of the biomarkers change. For example, biomarker "X" may be increased with brain injury, while biomarker "Y" may be decreased with brain injury. Therefore, the trend of these biomarkers, either increased or decreased over time toward neurological injury or brain injury, or recovery, indicates the course of the condition. Accordingly, this method involves measuring the level of one or more biomarkers in a patient at least two different time points, e.g., at a first time point and at a second time point, and comparing the change, if any. The course of brain injury, as well as a determination of injury status, are determined based on these comparisons.

Patient Management

In certain embodiments, methods of identifying or qualifying the status of a neurological injury or a brain injury, e.g., TBI, mTBI or concussion include determining and/or managing patient treatment based on injury status and/or risk. Such management includes the decisions and actions of the medical practitioner, physician, or clinician subsequent to determining brain injury status, e.g., as to TBI, mTBI, or concussion. For example, if a physician makes a diagnosis of TBI, mTBI or concussion, then a certain monitoring regimen would follow. An assessment of the course of brain injury using the described methods may then require a certain treatment or therapy regimen. Profiles of the levels of a set of biomarkers in the biological sample, combined with the age, sex, and acute symptoms of a patient, can provide a risk stratification (high risk, lower risk, or little to no risk likelihood of developing a certain post-TBI outcome, such as seizures, chronic pain, chronic headache, post-concussive symptoms, incomplete recovery assessed by GOS-E <8, sleep disturbances, mild to severe depressive symptoms, mild to severe anxiety, PTSD, chronic headache, poor attention or cognitive performance, or motor deficits). Each model profile with these biomarkers allows the physician to better make an informed decision to direct the TBI, mild TBI, or concussion patient down a treatment pathway tailored for each of the outcomes for which he or she is at high risk. An assessment of the course of brain injury using the described methods may then require a certain treatment or therapy regimen, including identifying an individual's eligibility for clinical trials that investigate therapeutics for a symptom or set of symptoms that results from TBI. Alternatively, a diagnosis of no brain injury might be followed with further testing or monitoring. Also, further tests may be called for if the diagnostic test gives an inconclusive result for neurological or brain injury status.

In one aspect, methods of treatment for post-TBI outcomes include: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptide biomarkers derived therefrom, in a control sample; stratifying the risk of the patient at one or more time points for post-TBI outcome when the measured levels of the one or more protein biomarkers, or peptide biomarkers derived therefrom, are increased or decreased in the subject's sample relative to the control levels; and if the risk stratification of the patient is high, administering a therapy or an effective amount of a drug specific to the post TBI outcome to treat the patient. In the exemplary methods of treatment of the invention, the protein biomarker panel includes a plurality of protein biomarkers selected from: (A) a subset of one or more, two or more, three or more, four or more, five or more, six or more, seven or more, eight or more, nine or more, or ten or more, protein biomarkers selected from protein Nos. 1-81 from Table 1; and, optionally, (B) one or more protein biomarkers selected from BDNF, GFAP, ICAM5, SNCB, MT3, NRGN, NSE, and ALDOC.

In one embodiment, a method treatment of post-TBI seizures includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI seizures when the measured levels of the one or more protein biomarkers, or peptide biomarkers derived therefrom, are increased or decreased in the subject's sample relative to the control levels; and if the risk stratification of the patient is high, administering an effective amount of an antiepileptic drug, such as Keppra, Depakote, or Gabapentin, to the patient.

In another embodiment, a method of treating post-TBI depression includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient for at one or more time points post-TBI depression when the measured levels of the one or more protein biomarkers, or peptide biomarkers derived therefrom, are increased or decreased in the subject's sample relative to the control levels; and if the risk stratification of the patient is high, administering psychotherapy or psychiatry or an effective amount of an antidepressant, such as Prozac or Elavil to the patient.

In another embodiment, a method of treating post-TBI anxiety includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI anxiety when the measured levels of the one or more protein biomarkers, or peptide biomarkers derived therefrom, are increased or decreased in the subject's sample relative to the control levels; and if the risk stratification of the patient is high, administering psychotherapy or psychiatry or an effective amount of an anxiolytic depressant, such as Xanax, Librium, Klonopin, or Ativan to the patient.

In another embodiment, a method of treating post-TBI post-traumatic stress disorder (PTSD) includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI PTSD when the measured levels of the one or more protein biomarkers, or peptide biomarkers derived therefrom, are increased or decreased in the subject's sample relative to the control levels; and if the risk stratification of the patient is high, administering psychotherapy or psychiatry to the patient.

In yet another embodiment, a method of treating post-TBI sleep disorder includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI sleep disorder when the measured levels of the one or more protein biomarkers, or peptide biomarkers derived therefrom, are increased or decreased in the subject's sample relative to the control levels; and if the risk stratification of the patient is high, administering therapy at a sleep clinic or an effective amount of sleep aid, such as melatonin or Advil PM to the patient.

In yet another embodiment, a method of treating post-TBI headache includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI headache when the measured levels of the one or more protein biomarkers, or peptide biomarkers derived therefrom, are increased or decreased in the subject's sample relative to the control levels; and if the risk stratification of the patient is high, administering an effective amount of analgesic, such as ibuprofen, acetaminophen to the patient.

In yet another embodiment, a method of treating post-TBI chronic pain includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI chronic pain when the measured levels of the one or more protein biomarkers, or peptide biomarkers derived therefrom, are increased or decreased in the subject's sample relative to the control levels; and if the risk stratification of the patient is high, administering therapy from a pain specialist or an effective amount of analgesic, such as opioids or cannabidiols to the patient.

In yet another embodiment, a method of treating post-TBI oculomotor deficits includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI oculomotor deficits when the measured levels of the one or more protein biomarkers, or peptide biomarkers derived therefrom, are increased or decreased in the subject's sample relative to the control levels; and if the risk stratification of the patient is high, administering vision therapy to the patient.

In yet another embodiment, a method of treating post-TBI attention and cognitive defects includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI attention and cognitive defects when the measured levels of the one or more protein biomarkers, or peptide biomarkers derived therefrom, are increased or decreased in the subject's sample relative to the control levels; and if the risk stratification of the patient is high, administering cognitive therapy to the patient.

In yet another embodiment, a method of treating post-TBI balance and gait problems includes: detecting whether a plurality of protein biomarkers in a protein biomarker panel, or peptide biomarkers derived therefrom, are present in a biological sample obtained from a patient; measuring the levels of the one or more protein biomarkers, or peptide biomarkers derived therefrom, present in the biological sample relative to the levels of the same proteins, or peptides derived therefrom, in a control sample; stratifying the risk of the patient at one or more time points for post-TBI balance and gait problems when the measured levels of the one or more protein biomarkers, or peptide biomarkers derived therefrom, are increased or decreased in the subject's sample relative to the control levels; and if the risk stratification of the patient is high, administering physical therapy to the patient.

Determining Therapeutic Efficacy of Pharmaceutical Drug

In another embodiment, methods are provided for determining the therapeutic efficacy of a pharmaceutical drug or treatment. These methods are useful in performing clinical trials of the drug, as well as monitoring the progress of a patient undergoing treatment with the drug. Therapy or clinical trials involve administering the drug in a particular regimen. The regimen may involve a single dose of the drug, or multiple doses of the drug over time. The doctor or clinical researcher monitors the effect of the drug on the patient or subject over the course of administration. If the drug has a pharmacological impact on the condition, the amounts or relative amounts (e.g., the pattern, profile or ratio) of one or more of the biomarkers described herein may change toward a neurological injury or brain injury status profile, such as TBI, mTBI or concussion. Therefore, the course of one or more biomarkers in the patient can be followed or monitored during the course of treatment. Accordingly, this method involves measuring one or more biomarkers in a patient receiving drug therapy, and correlating the biomarker levels/ratios with the brain injury status of the patient (e.g., by comparison to predefined levels/ratios of the biomarkers that correspond to different brain injury statuses). An embodiment of this method involves determining the levels/ratios of one or more biomarkers for at least two different time points during a course of drug therapy, e.g., a first time and a second time, and comparing the change in levels/ratios of the biomarkers, if any. For example, the levels/ratios of one or more biomarkers can be measured before and after drug administration or at two different time points during drug administration. The effect of therapy is determined based on these comparisons. If a treatment is effective, then the level/ratio of one or more biomarkers will trend toward normal, while if treatment is ineffective, the level/ratio of one or more biomarkers will trend toward a particular brain injury status.

Generation of Classification Algorithms for Qualifying Brain Injury Status

In some embodiments, data that are generated using samples such as "known samples" can then be used to "train" a classification model. A "known sample" is a sample that has been pre-classified. The data that are used to form the classification model can be referred to as a "training data set." The training data set that is used to form the classification model may include raw data or pre-processed data. Once trained, the classification model can recognize patterns in data generated using unknown samples. The classification model can then be used to classify the unknown samples into classes. This can be useful, for example, in predicting whether or not a particular biological sample is associated with a certain biological condition (e.g., brain injury versus no brain injury).

Classification models can be formed using any suitable statistical classification or learning method that attempts to segregate bodies of data into classes based on objective parameters present in the data. Classification methods may be either supervised or unsupervised. Examples of supervised and unsupervised classification processes are described in Jain, "Statistical Pattern Recognition: A Review", *IEEE Transactions on Pattern Analysis and Machine Intelligence*, Vol. 22, No. 1, January 2000, the teachings of which are incorporated by reference.

In supervised classification, training data containing examples of known categories are presented to a learning mechanism, which learns one or more sets of relationships that define each of the known classes. New data may then be applied to the learning mechanism, which then classifies the new data using the learned relationships. Examples of supervised classification processes include linear regression processes (e.g., multiple linear regression (MLR), partial least squares (PLS) regression and principal components regression (PCR)), binary decision trees (e.g., recursive partitioning processes such as CART), artificial neural networks such as back propagation networks, discriminant analyses (e.g., Bayesian classifier or Fischer analysis), logistic classifiers, and support vector classifiers (support vector machines).

Another supervised classification method is a recursive partitioning process. Recursive partitioning processes use recursive partitioning trees to classify data derived from unknown samples. Further details about recursive partitioning processes are provided in U.S. Patent Application Publication No. 2002/0138208 A1 to Paulse et al., "Method for analyzing mass spectra."

In other embodiments, the classification models that are created can be formed using unsupervised learning methods. Unsupervised classification attempts to learn classifications based on similarities in the training data set, without pre-classifying the spectra from which the training data set was derived. Unsupervised learning methods include cluster analyses. A cluster analysis attempts to divide the data into "clusters" or groups that ideally should have members that are very similar to each other, and very dissimilar to members of other clusters. Similarity is then measured using some distance metric, which measures the distance between data items, and clusters together data items that are closer to each other. Clustering techniques include the MacQueen's K-means algorithm and the Kohonen's Self-Organizing Map algorithm.

Learning algorithms asserted for use in classifying biological information are described, for example, in PCT International Publication No. WO 01/31580 (Barnhill et al., "Methods and devices for identifying patterns in biological systems and methods of use thereof"), U.S. Patent Application Publication No. 2002/0193950 (Gavin et al. "Method or analyzing mass spectra"), U.S. Patent Application Publication No. 2003/0004402 (Hitt et al., "Process for discriminating between biological states based on hidden patterns from biological data"), and U.S. Patent Application Publication No. 2003/0055615 (Zhang and Zhang, "Systems and methods for processing biological expression data").

The classification models can be formed on and used on any suitable digital computer. Suitable digital computers include micro, mini, or large computers using any standard or specialized operating system, such as a UNIX, WINDOWS® or LINUX™ based operating system. In embodiments utilizing a mass spectrometer, the digital computer that is used may be physically separate from the mass spectrometer that is used to create the spectra of interest, or it may be coupled to the mass spectrometer.

The training data set and the classification models according to embodiments of the invention can be embodied by computer code that is executed or used by a digital computer. The computer code can be stored on any suitable computer readable media including optical or magnetic disks, sticks, tapes, etc., and can be written in any suitable computer programming language including R, C, C++, visual basic, etc.

The learning algorithms described above are useful both for developing classification algorithms for the biomarkers already discovered, and for finding new biomarker biomarkers. The classification algorithms, in turn, form the base for diagnostic tests by providing diagnostic values (e.g., cut-off points) for biomarkers used singly or in combination.

Kits for the Detection of Biomarkers

In another aspect, embodiments of the invention provide kits for detecting, identifying, assessing, diagnosing, evaluating, or qualifying neurological injury or brain injury or the status thereof, e.g., qualifying TBI, mTBI or concussion, in a patient (subject). The kits are used to detect the protein biomarkers in the protein, or to detect a peptide derived therefrom. In a specific embodiment, the kit is provided as an ELISA kit including antibodies, or an antigen binding fragment thereof, that bind to one or more of, or a subset of, the plurality of protein biomarkers in protein biomarker panel, or a bindable peptide thereof.

The ELISA kit may include a solid support, such as a chip, microtiter plate (e.g., a 96-well plate), beads, or resin having protein biomarker capture reagents (e.g., binding molecules) attached thereon. The kit may further include a means for detecting the protein biomarkers, such as antibodies, and a secondary antibody-signal complex such as horseradish peroxidase (HRP)-conjugated goat anti-rabbit IgG antibody and tetramethyl benzidine (TMB) as a substrate for HRP.

The kit may be provided as an immuno-chromatography strip including a membrane on which specific antibodies are immobilized, and a means for detecting, e.g., gold particle bound antibodies, where the membrane, includes NC membrane and PVDF membrane. In certain embodiments, neurological injury or brain injury in a patient can be detected or diagnosed by adding to the kit a biological sample (e.g., blood or serum) obtained from the patient and detecting the relevant protein biomarkers that are bound to detectable antibodies, for example, by a method which includes: (i) collecting blood or serum from the patient; (ii) adding the blood or serum from the patient to the diagnostic kit; and, (iii) detecting the biomarkers bound to the antibodies. Use of the kit brings bound antibodies into contact with the patient's sample, such as blood or serum. If protein biomarkers of the protein biomarker panel (or peptides thereof) are present in the sample, the antibodies or antigen binding fragments thereof will bind to the proteins (or peptides thereof) in the sample, and are detected. In other kit and diagnostic embodiments, blood or serum is not collected from the patient (i.e., it is already collected). In other embodiments, the sample may include a tissue sample or a clinical sample, which may be processed prior to contact with detection antibodies.

The kit can also include a washing solution or instructions for making a washing solution, in which the combination of the capture reagents and the washing solution allows capture of the biomarkers on the solid support for subsequent detection by, e.g., antibodies, such as by using an immunoassay or mass spectrometry. In a further embodiment, a kit can include instructions in the form of a label or separate insert. For example, the instructions may inform the user about how to collect the sample, and how to wash a support or substrate on which the particular biomarkers are bound and can be detected, etc. In yet another embodiment, the kit can include one or more containers with control biomarker samples, to be used as standard(s) or references for calibration or normalization.

The practice of the principles of the invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

Without further elaboration, it is believed that one skilled in the art, using the preceding description, can utilize the invention to the fullest extent. The following examples are illustrative only, and not limiting of the remainder of the disclosure or claims in any way whatsoever. In addition, the examples are put forth so as to provide those of ordinary skill in the art with a complete disclosure, description and exemplification of how to make and use the assay, screening, assessing, monitoring and therapeutic methods of the invention, and are not intended to limit the scope of what the inventors regard as their invention.

EXAMPLES

In the following examples, efforts have been made to ensure accuracy with respect to numbers (e.g., amounts, temperature, etc.) but some errors and deviations should be accounted for herein. Unless indicated otherwise, parts are parts by weight, temperature is in degrees Celsius or is at ambient temperature, and pressure is at or near atmospheric. There are numerous variations and combinations of reaction conditions, e.g., component concentrations, desired solvents, solvent mixtures, temperatures, pressures and other reaction ranges and conditions that can be used to optimize the product purity and yield obtained from the described process. Only reasonable and routine experimentation will be required to optimize such process conditions.

Example 1

Discovery of Biomarkers for Neurological Injury and Disease

The protein biomarkers presented in Table 1, and their amino acids sequences provided in the sequence listing filed herewith, were discovered by pooling serum from patients having TBI using 2D gel electrophoresis (PF2D), which used isoelectric focusing (separation by isoelectric focusing point, pI), followed by hydrophobicity focusing (separation by hydrophobicity). Separated proteins resolved by these methods were purified and sequenced (their amino acid sequences were determined) via mass spectroscopy using routine procedures.

In particular, serum proteins from healthy subjects (control pools) and serum proteins from patients with brain injury (brain injury patient pools) were separated by 2D gel electrophoresis involving isoelectric and hydrophobicity focusing. The resolved individual antigen (protein) fractions were printed (spotted) onto custom microarrays (i.e., microarrayed proteins printed from separated proteins from patient serum) and were probed with serum from human patients having acute to chronic brain injury, as well as with antibodies to known antigens. The reactivities of the antibodies against the proteins in the samples were detected with species-specific anti-IgG or anti-IgM antibodies with fluorescent tags. Candidate fractions were chosen for sequencing. Mass spectroscopy amino acid sequencing and bioinformatics were performed to identify candidate biomarkers that were differentially expressed (i.e., at higher or lower levels, based on fluorescence signals) in patients who had traumatic brain injury compared to controls (subject without TBI or with acute or milder forms of TBI). Several time points after injury were examined using the spotted TBI-protein or healthy control-protein arrays in order to discover the proteome of proteins that were indicative of neurological injury or brain injury, such as TBI.

The protein biomarkers discovered by using the above-designed strategy of proteomic profiling of proteins in serum samples from patients having brain injury, such as TBI, compared with proteins in serum samples from healthy controls, provide concrete and isolatable components (biomarkers) that result from neurological injury or brain injury in subjects with these conditions. These protein biomarker components further provide an indication of the many types of cells and tissues, as well as the cell and tissue damage, that constitute identified and detectable neurological injury-related or brain injury-related components in a patient's sample, such as serum. These biomarker components include proteins whose increased or decreased amounts or levels correlate with neurological injury or brain injury in patients, compared with the amounts or levels of these component proteins in control subjects who do not have the neurological injury or brain injury (e.g., non-TBI subjects).

The isolation and identification methods described above resulted in the identification of new protein biomarkers associated or correlated with, or indicative of, neurological injury or brain injury, such as neuron-enriched proteins, e.g., KCNMA1, FRMDP4, that correlate with synaptogenesis, neural signaling and neuronal survival (Lee et al., 2008, *J. Neurosci.*, 28(53):14546-56). In addition, protein biomarkers of vascular integrity, e.g., von Willebrand factor (vWF), (Gong et al., 2016, *Neurology*, 86(16): S11.001), initially reported in tumor angiogenesis and TBI were detected by the above method. Transcription factors that control injury-related phenotypes and gene expression, e.g., ZNF652, (Callen et al., 2010, *Oncol. Rep*, 23(4):1045-52) were detected in TBI samples, and proteases common to injury and restructuring, such as Cathepsin D (CTSD) and Kallikrein (KRKR1) were also discovered by the above described methods. These proteins identified and described herein are component parts of the cellular machinery that is involved with the normal turnover of cells and tissues. These proteins are also enhanced after tissue injury due to the cascade of injury-related restructuring processes that are activated in cells to remove and clear cell debris, damaged cell fragments, and extracellular matrix in order to allow regrowth and tissue repair in an injured subject. Thus, the proteins presented in Table 1 provide new proteins for use in detection, assessment, diagnostic, and/or prognostic methods as indicators of neurological injury or disease, injury of the nervous system, or brain injury. The methods described using these proteins as neurological or brain injury biomarkers afford more efficient, reliable and economical means and procedures for patients having, suspected of having, or at risk of having various types of neurological injury or disease or brain injury, such as TBI or mTBI, to receive determinative medical assessments, advice, treatments, therapies and outcomes.

Example 3

Detection of Autoantibodies to Proteins to Specific Candidate TBI Biomarkers

Figure 3:
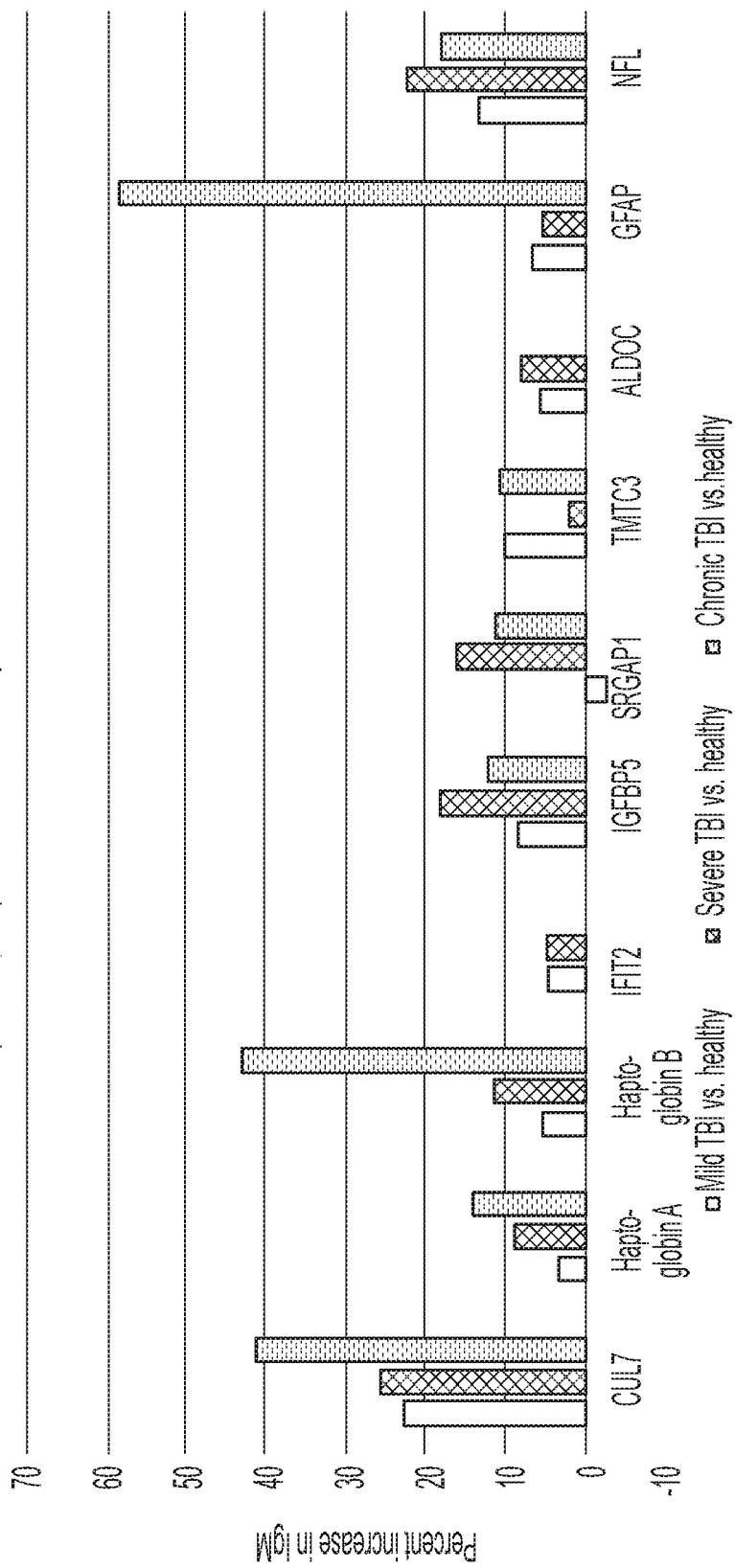
FIG. 3 shows the levels of auto-antibody reactivity against human proteins captured from serum using specific monoclonal antibodies and anti-human IgM detection antibody (electrochemiluminescence detection using MSD read buffer and a Quickplex 120 luminescence reader). Autoantibodies detected include anti-Haptoglobin, anti-Cullin-7, and known auto antibody TBI biomarkers such as anti-GFAP.

Auto-antibodies of proteins to specific candidate TBI biomarker proteins were detected in serum samples in sandwich immunoassays. Serum was diluted 1:20 in 1.5% bovine serum albumin (BSA) containing phosphate buffered saline (PBS blocking buffer) supplemented with Tween-20 detergent. Capture monoclonal antibodies raised against 10 specific human TBI antigen proteins were used to coat 96 well microtiter plates in PBS. Antibody coated wells were washed and incubated in blocking buffer, then incubated with diluted serum. FIG. 3 demonstrates the detected increase in auto-antibody reactivity against human proteins captured from serum using specific monoclonal antibodies and anti-human IgM detection antibody (electrochemiluminescence detection using MSD read buffer and a Quickplex 120 luminescence reader). Auto-antibodies detected include anti-Haptoglobin, anti-Cullin-7, and known auto antibody TBI biomarkers such as anti-GFAP.

Example 4

Figure 4:
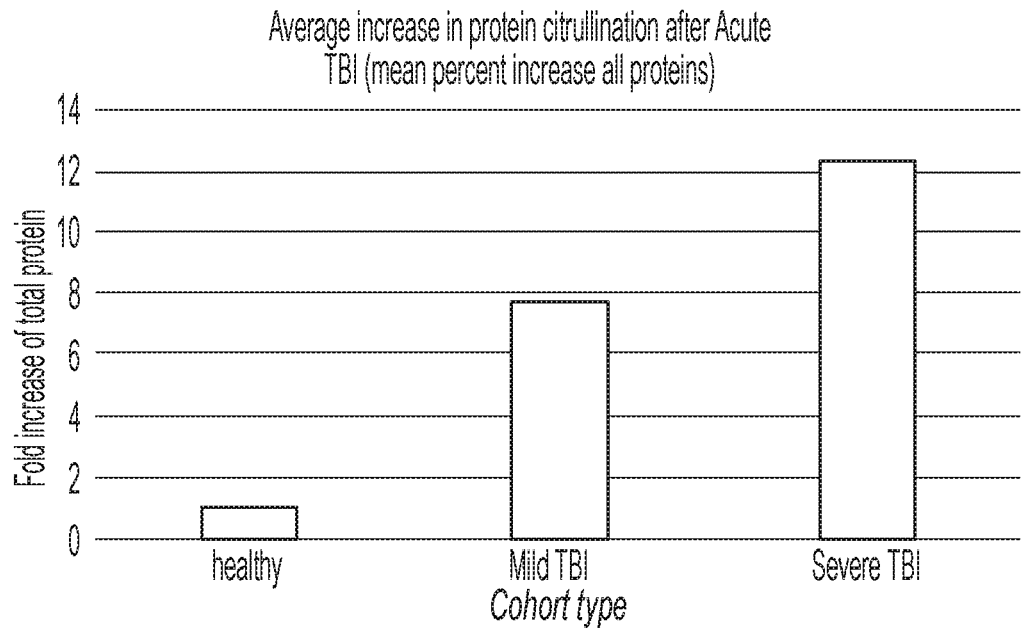
FIG. 4 shows detection of an overall increase in the average percent citrullination levels in TBI serum samples compared to healthy controls, averaged over the 10 proteins tested. Level of citrullination was detected by immunocapture using TBI antigen specific antibodies and detected with anti-citrulline antisera.

Citrullination levels in specific proteins for TBI protein biomarkers were detected in serum samples in sandwich immunoassays as follows. Serum was diluted 1:20 in 1.5% bovine serum albumin (BSA) containing phosphate buffered saline (PBS blocking buffer) supplemented with Tween-20 detergent. Capture monoclonal antibodies raised against 10 specific human TBI antigen proteins were used to coat 96 well microtiter plates in PBS. Antibody coated wells were washed and incubated in blocking buffer, then incubated with diluted serum. FIG. 4 demonstrates the detected increase in citrullinated amino acids for the 10 proteins studied, as detected in the immunocaptured proteins using a citrullination-specific antibody reactivity of the captured human proteins (electrochemiluminescence detection using MSD read buffer and a Quickplex 120 luminescence reader) as an average, based on cohort.

Example 5

Figure 5:
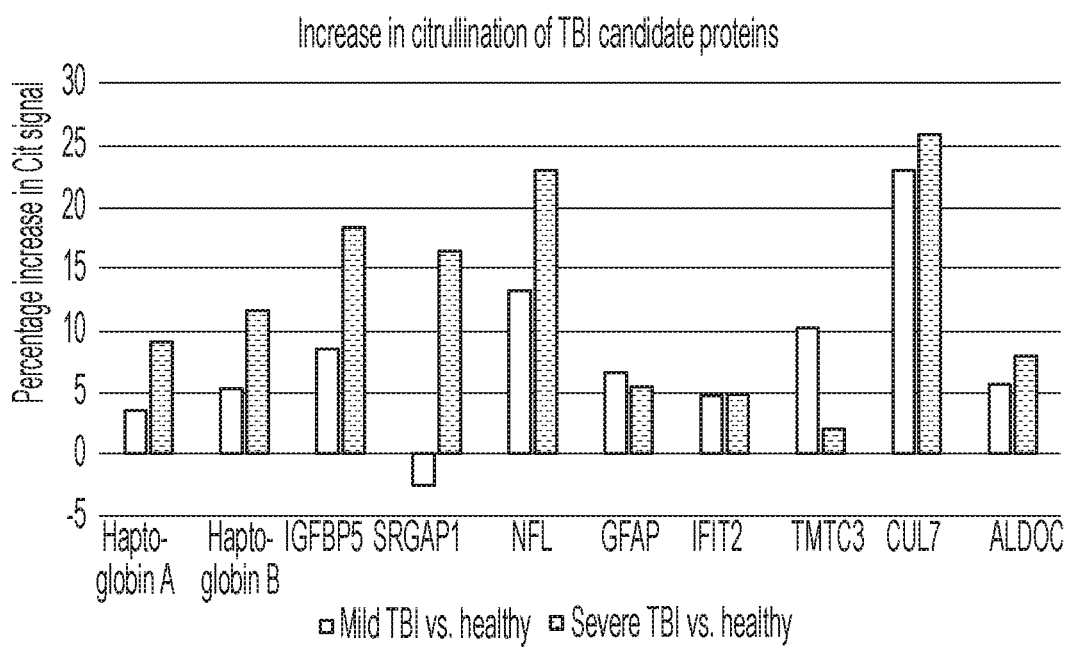
FIG. 5 shows detection of the average percent citrullination levels in TBI serum samples compared to controls, for the proteins tested.

Citrullination levels in specific proteins for TBI protein biomarkers were detected in serum samples in sandwich immunoassays as follows. Serum was diluted 1:20 in 1.5% bovine serum albumin (BSA) containing phosphate buffered saline (PBS blocking buffer) supplemented with Tween-20 detergent. Capture monoclonal antibodies raised against 10 specific human TBI antigen proteins were used to coat 96 well microtiter plates in PBS. Antibody coated wells were washed and incubated in blocking buffer, then incubated with diluted serum. FIG. 5 demonstrates the detected average increase in citrullinated amino acids for the 10 proteins studied, as detected in the immunocaptured proteins using a citrullination specific antibody reactivity of the captured human proteins (electrochemiluminescence detection using MSD read buffer and a Quickplex 120 luminescence reader).

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or sub-combination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (81 sequences)

SEQ ID NO: 1 - protein, 248 aa, Homo sapiens [sequence omitted]

SEQ ID NO: 2 - protein, 1684 aa, Homo sapiens
MSYWNLEKRNCVQYRRHFLVDNSVFHVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 3 - protein, 2436 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 4 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 5 - protein, 823 aa, Homo sapiens
MKLFGFGSRRGQTAQGSIDHVYTGSGYRIRDSELQKIHRAAVKGDAAEVERCLARRSGELDALDKQHRTALHLACASGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQQRHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTQDVSVQVEMSSAISKVKDENEFLTEQLSETQIKFNALKDKFRKTRDSLRKKSLALETVQNNLSQTQQQTQEMKEMYQNAEAKVNNSTGKWNCVEERICHLQRENAWLVQQLDDVHQKEDHKEIVTNIQRGFIESGKKDFVLEEKSKKLMNECDHLKESLFQYEREKTEVVVSIKEDKYFQTSRKKI

SEQ ID NO: 6 - protein, 357 aa, Homo sapiens
MGRQLAGCGDAGKKASFKMSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 7 - protein, 1101 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEEEDLSLIETHVGLLGEYTEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 8 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 9 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 10 - protein, 343 aa, Homo sapiens
MSSGASRKSWDPGNPWPPDWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDNH

SEQ ID NO: 11 - protein, 237 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 12 - protein, 1288 aa, Homo sapiens
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 13 - protein, 476 aa, Homo sapiens
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 14 - protein, 3051 aa, Homo sapiens
MATNPQPQPPPPAPPPPPPQPQPQPPPPPPGPGAGPGAGGAGGAGAGAGDPQLVAMIVNHLKSQGLFDQFRRDCLADVDTKPAYQNLRQRVDNFVANHLATHTWSPHLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSSKDIKKKDENKSDDKDGKEVDSSHEKARGNSSLMEKKLSRRLCENRRGSLSQEMAKGEEKLAANTLSTPSGSSLQRPKKSGDMTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 15 - protein, 1208 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 16 - protein, 149 aa, Homo sapiens [sequence omitted]

SEQ ID NO: 17 - protein, 149 aa, Homo sapiens
MADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 18 - protein, 146 aa, Homo sapiens
MAGELTPEEEAQYKKAFSAVDTDGNGTINAQELGAALKATGKNLSEAQLRKLISEVDSDGDGEISFQEFLTAAKKARAGLEDLQVAFRAFDQDGDGHITVDELRRAMAGLGQPLPQEELDAMIREADVDQDGRVNYEEFARMLAQE

SEQ ID NO: 19 - protein, 261 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 20 - protein, 242 aa, Homo sapiens
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 21 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 22 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 23 - protein, 3014 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 24 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 25 - protein, 612 aa, Homo sapiens
LLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 26 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 27 - protein, 559 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 28 - protein, 1231 aa, Homo sapiens [sequence omitted]

SEQ ID NO: 29 - protein, 330 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 30 - protein, 1782 aa, Homo sapiens
MSRGFWLAEPLAGTGPHPAPVAADSRGCSSVPRRHAPSRLSVSTPSRGPGARMVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGEGQCGEEGKAGEGLGRLRDSQDTVAGASDLIRTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 31 - protein, 894 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 32 - protein, 824 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 33 - protein, 1401 aa, Homo sapiens
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 34 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 35 - protein, 135 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 36 - protein, 1322 aa, Homo sapiens
MDVFSFVKIAKLSSHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTV

SEQ ID NO: 37 - protein, 382 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 38 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 39 - protein, 136 aa, Homo sapiens
MSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 40 - protein, 188 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 41 - protein, 226 aa, Homo sapiens
  MISC_FEATURE (73)..(73): selenocysteine
MARLLQASCLLSLLLAGFVSQSRGQEKSKMDCHGGISGTIYEYGALTIDGEEYIPFKQYAGKYVLFVNVASYXGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 42 - protein, 189 aa, Homo sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 43 - protein, 406 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 44 - protein, 525 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 45 - protein, 3972 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSGTEDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 46 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 47 - protein, 3333 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 48 - protein, 347 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 49 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 50 - protein, 61 aa, Homo sapiens
MDPNCSCSPVGSCACAGSCKCKECKCTSCKKSCCSCCPVGCAKCAQGCICKGTSDKCSCCA

SEQ ID NO: 51 - protein, 1140 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 52 - protein, 2385 aa, Homo sapiens
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASASPLVWPPKKRQNGPVIYKHRSRICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 53 - protein, 576 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 54 - protein, 913 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 55 - protein, 908 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSSEEDEEEEEEEGEEDEEGQKVTIHDKTEINLVSFRRTIYLAIQSSLDFEECAHKLLKMEFPESQTKELCNMILDCCAQQRTYEKFFGLLAGRFCMLKKEYMESFEGIFKEQYDTIHRLETNKLRNVAKMFAHLLYTDSLPWSVLECIKLSEETTTSSSRIFVKIFFQELCEYMGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDVRKKGHGKTRSKEVDKLIRNQQTNDRKQKERRQEHGHQETRTERERRSEKHRDQNSSGSNWRDPITKYTSDKDVPSERNNYSRVANDRDQEMHIDLENKHGDPKKKRGERRNSFSENEKHTHRIKDSENFRRKDRSKSKEMNRKHSGSRSDEDRYQNGAERRWEKSSRYSEQSRESKKNQDRRREKSPAKQK

SEQ ID NO: 56 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 57 - protein, 101 aa, Homo sapiens
MSNTQAERSIIGMIDMFHKYTRRDDKIEKPSLLTMMKENFPNFLSACDKKGTNYLADVFEKKDKNEDKKIDFSEFLSLLGDIATDYHKQSHGAAPCSGGSQ

SEQ ID NO: 58 - protein, 117 aa, Homo sapiens
MSLVSCLSEDLKVLFFRWGKSVGIMLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 59 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 60 - protein, 2426 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSLPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLRNGALTRPNCMFFLNRY

SEQ ID NO: 61 - protein, 370 aa, Homo sapiens
MVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 62 - protein, 917 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRGRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 63 - protein, 835 aa, Homo sapiens
MGNYKSRPTQTCTDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 64 - protein, 425 aa, Homo sapiens
MDSLVTANTKFCFDLFQEIGKDDRHKNIFFSPLSLSAALGMVRLGARSDSAHQIDEVLHFNEFSQNESKEPDPCLKSNKQKVLADSSLEGQKKTTEPLDQQAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 65 - protein, 390 aa, Homo sapiens
MNSLSEANTKFMFDLFQQFRKSKENNIFYSPISITSALGMVLLGAKDNTAQQIKKVLHFDQVTENTTGKAATYHVDRSGNVHHQFQKLLTEFNKSTDAYELKIANKLFGEKTYLFLQEYLDAIKKFYQTSVESVDFANAPEESRKKINSWVESQTNEKIKNLIPEGNIGSNTTLVLVNAIYFKGQWEKKFNKEDTKEEKFWPNKNTYKSIQMMRQYTSFHFASLEDVQAKVLEIPYKGKDLSMIVLLPNEIDGLQKLEEKLTAEKLMEWTSLQNMRETRVDLHLPRFKVEESYDLKDTLRTMGMVDIFNGDADLSGMTGSRGLVLSGVLHKAFVEVTEEGAEAAAATAVVGFGSSPTSTNEEFHCNHPFLFFIRQNKTNSILFYGRFSSP

SEQ ID NO: 66 - protein, 390 aa, Homo sapiens
MNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 67 - protein, 1085 aa, Homo sapiens
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 68 - protein, 122 aa, Homo sapiens
MKLLTGLVFCSLVLGVSSRSFFSFLGEAFDGARDMWRAYSDMREANYIGSDKYFHARGNYDAAKRGPGGAWAAEVISDARENIQRFFGHGAEDSLADQAANEWGRSGKDPNHFRPAGLPEKY

SEQ ID NO: 69 - protein, 130 aa, Homo sapiens
MRLFTGIVFCSLVMGVTSESWRSFFKEALQGVGDMGRAYWDIMISNHQNSNRYLYARGNYDAAQRGPGGVWAAKLISRSRVYLQGLIDCYLFGNSSTVLEDSKSNEKAEEWGRSGKDPDRFRPDGLPKKY

SEQ ID NO: 70 - protein, 223 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 71 - protein, 72 aa, Homo sapiens
MSYQQQQCKQPCQPPPVCPTPKCPEPCPPPKCPEPCPPPKCPQPCPPQQCQQKCPPVTPSPPCQPKCPPKSK

SEQ ID NO: 72 - protein, 855 aa, Homo sapiens
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 73 - protein, 2785 aa, Homo sapiens
MKTKPVSHKTENTYRFLTFAERLGNVNIDIIHRIDRTASYEEEVETYFFEGLLKWRELNLTEHFGKFYKEVIDKCQSFNQLVYHQNEIVQSLKTHLQVKNSFAYQPLLDLVVQLARDLQMDFYPHFPEFFLTITSILETQDTELLEWAFTSLSYLYKYLWRLMVKDMSSIYSMYSTLLAHKKLHIRNFAAESFTFLMRKVSDKNALFNLMFLDLDKHPEKVEGVGQLLFEMCKGVRNMFHSCTGQAVKLILRKLGPVTETETQLPWMLIGETLKNMVKSTVSYISKEHFGTFFECLQESLLDLHTKVTKTNCCESSEQIKRLLETYLILVKHGSGTKIPTPADVCKVLSQTLQVASLSTSCWETLLDVISALILGENVSLPETLIKETIEKIFESRFEKRLIFSFSEVMFAMKQFEQLFLPSFLSYIVNCFLIDDAVVKDEALAILAKLILNKAAPPTAGSMAIEKYPLVFSPQMVGFYIKQKKTRSKGRNEQFPVLDHLLSIIKLPPNKDTTYLSQSWAALVVLPHIRPLEKEKVIPLVTGFIEALFMTVDKGSFGKGNLFVLCQAVNTLLSLEESSELLHLVPVERVKNLVLTFPLEPSVLLLTDLYYQRLALCGCKGPLSQEALMELFPKLQANISTGVSKIRLLTIRILNHFDVQLPESMEDDGLSERQSVFAILRQAELVPATVNDYREKLLHLRKLRHDVVQTAVPDGPLQEVPLRYLLGMLYINFSALWDPVIELISSHAHEMENKQFWKVYYEHLEKAATHAEKELQNDMTDEKSVGDESWEQTQEGDVGALYHEQLALKTDCQERLDHTNFRFLLWRALTKFPERVEPRSRELSPLFLRFINNEYYPADLQVAPTQDLRRKGKGMVAEEIEEEPAAGDDEELEEEAVPQDESSQKKKTRRAAAKQLIAHLQVFSKFSNPRALYLESKLYELYLQLLLHQDQMVQKITLDCIMTYKHPHVLPYRENLQRLLEDRSFKEEIVHFSISEDNAVVKTAHRADLFPILMRILYGRMKNKTGSKTQGKSASGTRMAIVLRFLAGTQPEEIQIFLDLLFEPVRHFKNGECHSAVIQAVEDLDLSKVLPLGRQHGILNSLEIVLKNISHLISAYLPKILQILLCMTATVSHILDQREKIQLRFINPLKNLRRLGIKMVTDIFLDWESYQFRTEEIDAVFHGAVWPQISRLGSESQYSPTPLLKLISIWSRNARYFPLLAKQKPGHPECDILTNVFAILSAKNLSDATASIVMDIVDDLLNLPDFEPTETVLNLLVTGCVYPGIAENIGESITIGGRLILPHVPAILQYLSKTTISAEKVKKKKNRAQVSKELGILSKISKFMKDKEQSSVLITLLLPFLHRGNIAEDTEVDILVTVQNLLKHCVDPTSFLKPIAKLFSVIKNKLSRKLLCTVFETLSDFESGLKYITDVVKLNAFDQRHLDDINFDVRFETFQTITSYIKEMQIVDVNYLIPVMHNCFYNLELGDMSLSDNASMCLMSIIKKLAALNVTEKDYREIIHRSLLEKLRKGLKSQTESIQQDYTTILSCLIQTFPNQLEFKDLVQLTHYHDPEMDFFENMKHIQIHRRARALKKLAKQLMEGKVVLSSKSLQNYIMPYAMTPIFDEKMLKHENITTAATEIIGAICKHLSWSAYMYYLKHFIHVLQTGQINQKLGVSLLVIVLEAFHFDHKTLEEQMGKIENEENAIEAIELPEPEAMELERVDEEEKEYTCKSLSDNGQPGTPDPADSGGTSAKESECITKPVSFLPQNKEEIERTIKNIQGTITGDILPRLHKCLASTTKREEEHKLVKSKVVNDEEVVRVPLAFAMVKLMQSLPQEVMEANLPSILLKVCALLKNRAQEIRDIARSTLAKIIEDLGVHFLLYVLKELQTTLVRGYQVHVLTFTVHMLLQGLTNKLQVGDLDSCLDIMIEIFNHELFGAVAEEKEVKQILSKVMEARRSKSYDSYEILGKFVGKDQVTKLILPLKEILQNTTSLKLARKVHETLRRITVGLIVNQEMTAESILLLSYGLISENLPLLTEKEKNPVAPAPDPRLPPQSCLLLPPTPVRGGQKAVVSRKTNMHIFIESGLRLLHLSLKTSKIKSSGECVLEMLDPFVSLLIDCLGSMDVKVITGALQCLIWVLRFPLPSIETKAEQLTKHLFLLLKDYAKLGAARGQNFHLVVNCFKCVTILVKKVKSYQITEKQLQVLLAYAEEDIYDTSRQATAFGLLKAILSRKLLVPEIDEVMRKVSKLAVSAQSEPARVQCRQVFLKYILDYPLGDKLRPNLEFMLAQLNYEHETGRESTLEMIAYLFDTFPQGLLHENCGMFFIPLCLMTINDDSATCKKMASMTIKSLLGKISLEKKDWLFDMVTTWFGAKKRLNRQLAALICGLFVESEGVDFEKRLGTVLPVIEKEIDPENFKDIMEETEEKAADRLLFSFLTLITKLIKECNIIQFTKPAETLSKIWSHVHSHLRHPHNWVWLTAAQIFGLLFASCQPEELIQKWNTKKTKKHLPEPVAIKFLASDLDQKMKSISLASCHQLHSKFLDQSLGEQVVKNLLFAAKVLYLLELYCEDKQSKIKEDLEEQEALEDGVACADEKAESDGEEKEEVKEELGRPATLLWLIQKLSRIAKLEAAYSPRNPLKRTCIFKFLGAVAMDLGIDKVKPYLPMIIAPLFRELNSTYSEQDPLLKNLSQEIIELLKKLVGLESFSLAFASVQKQANEKRALRKKRKALEFVTNPDIAAKKKMKKHKNKSEAKKRKIEFLRPGYKAKRQKSHSLKDLAMVE

SEQ ID NO: 74 - protein, 926 aa, Homo sapiens
MKKTRSTTLRRAWPSSDFSDRASDRMRSRSEKDYRLHKRFPAAFAPQASRGYMTSGDVSPISMSPISQSQFIPLGEILCLAISAMNSARKPVTQEALMEHLTTCFPGVPTPSQEILRHTLNTLVRERKIYPTPDGYFIVTPQTYFITPSLIRTNSKWYHLDERIPDRSQCTSPQPGTITPSASGCVRERTLPRNHCDSCHCCREDVHSTHAPTLQRKSAKDCKDPYCPPSLCQVPPTEKSKSTVNFSYKTETLSKPKDSEKQSKKFGLKLFRLSFKKDKTKQLANFSAQFPPEEWPLRDEDTPATIPREVEMEIIRRINPDLTVENVMRHTALMKKLEEEKAQRSKAGSSAHHSGRSKKSRTHRKSHGKSRSHSKTRVSKGDPSDGSHLDIPAEREYDFCDPLTRVPREGCFIIEHKGDNFIMHSNTNVLESHFPMTPEWDVSGELAKRRTEMPFPEPSRGSSHSKVHRSHSHTQDRRSRNERSNKAKERSRSMDNSKGPLGASSLGTPEDLAEGCSQDDQTPSQSYIDDSTLRPAQTVSLQRAHISSTSYKEVCIPEIVSGSKEPSSACSLLEPGKPPESLPSYGELNSCPTKTATDDYFQCNTSSETVLTAPSPLGKNKEDHDTLTLAEGVKKLSPSDRQVPHSSREPVGHKEESPKGPGGGPAASGGVAEGIANGRLVQHHGAEPSSLDKRKEIFSKDTLFKPLHSTLSVNSYHKSSLSLLKSHPKTPADTLPGRCEKLEPSLGTSAAQAMPASQRQQESGGNQEASFDYYNVSDDDDSEEGANKNTEEEKNREDVGTMQWLLEREKERDLQRKFEKNLTLLAPKETDSSSNQRATHSARLDSMDSSSITVDSGFNSPRTRESLASNTSSIVESNRRQNPALSPAHGGAGPAFNFRASAEPPTNEAEKLQKPSNCLQASVTSV

SEQ ID NO: 75 - protein, 2999 aa, Homo sapiens
MGNENSTSDNQQEDSVLHNVILWPPNPEPTQRTLSAQTPRSAQPPGNSQNIKRKQQDTPGSPDHRDASSIGSVGLGGFCTASESSASLDPCLVSPEVTEPRKDPQGARGPEGSLLPSPPPSQEREHPSSSMPFAECPPEGCLASPAAAPEDGPQTQSPRREPAPNAPGDIAAAFPAERDSSTPYQEIAAVPSAGRERQPKEEGQKSSFSFSSGIDQSPGMSPVPLREPMKAPLCGEGDQPGGFESQEKEAAGGFPPAESRQGVASVQVTPEAPAAAQQGTESSAVLEKSPLKPMAPIPQDPAPRASDRERGQGEAPPQYLTDDLEFLRACHLPRSNSGAAPEAEVNAASQESCQQPVGAYLPHAELPWGLPSPALVPEAGGSGKEALDTIDVQGHPQTGMRGTKPNQVVCVAAGGQPEGGLPVSPEPSLLTPTEEAHPASSLASFPAAQIPIAVEEPGSSSRESVSKAGMPVSADAAKEVVDAGLVGLERQVSDLGSKGEHPEGDPGEVPAPSPQERGEHLNTEQSHEVQPGVPPPPLPKEQSHEVQPGAPPPPLPKAPSESARGPPGPTDGAKVHEDSTSPAVAKEGSRSPGDSPGGKEEAPEPPDGGDPGNLQGEDSQAFSSKRDPEVGKDELSKPSSDAESRDHPSSHSAQPPRKGGAGHTDGPHSQTAEADASGLPHKLGEEDPVLPPVPDGAGEPTVPEGAIWEGSGLQPKCPDTLQSREGLGRMESFLTLESEKSDFPPTPVAEVAPKAQEGESTLEIRKMGSCDGEGLLTSPDQPRGPACDASRQEFHAGVPHPPQGENLAADLGLTALILDQDQQGIPSCPGEGWIRGAASEWPLLSSEKHLQPSQAQPETSIFDVLKEQAQPPENGKETSPSHPGFKDQGADSSQIHVPVEPQEDNNLPTHGGQEQALGSELQSQLPKGTLSDTPTSSPTDMVWESSLTEESELSAPTRQKLPALGEKRPEGACGDGQSSRVSPPAADVLKDFSLAGNFSRKETCCTGQGPNKSQQALADALEEGSQHEEACQRHPGASEAADGCSPLWGLSKREMASGNTGEAPPCQPDSVALLDAVPCLPALAPASPGVTPTQDAPETEACDETQEGRQQPVPAPQQKMECWATSDAESPKLLASFPSAGEQGGEAGAAETGGSAGAGDPGKQQAPEKPGEATLSCGLLQTEHCLTSGEEASTSALRESCQAEHPMASCQDALLPARELGGIPRSTMDFSTHQAVPDPKELLLSGPPEVAAPDTPYLHVDSAAQRGAEDSGVKAVSSADPRAPGESPCPVGEPPLALENAASLKLFAGSLAPLLQPGAAGGEIPAVQASSGSPKARTTEGPVDSMPCLDRMPLLAKGKQATGEEKAATAPGAGAKASGEGMAGDAAGETEGSMERMGEPSQDPKQGTSGGVDTSSEQIATLTGFPDFREHIAKIFEKPVLGALATPGEKAGAGRSAVGKDLTRPLGPEKLLDGPPGVDVTLLPAPPARLQVEKKQQLAGEAEISHLALQDPASDKLLGPAGLTWERNLPGAGVGKEMAGVPPTLREDERPEGPGAAWPGLEGQAYSQLERSRQELASGLPSPAATQELPVERAAAFQVAPHSHGEEAVAQDRIPSGKQHQETSACDSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGEAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQSISPAAAHAGLPPSAAEHIVSPSAPAGDRVEASTPSCPDPAKDLSRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEGKQLCSQLDPHSASENPAPREPKARRETSQPELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 76 - protein, 914 aa, Homo sapiens
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQVIQSQLPVFTRFDNPAAVSPTPTRQLTFNYLLPVNAWLLLNPSELCCDWTMGTIPLIESLLDIRNLATFTFFCFLGMLGVFSIRYSGDSSKTVLMALCLMALPFIPASNLFFPVGFVVAERVLYVPSMGFCILVAHGWQKISTKSVFKKLSWICLSMVILTHSLKTFHRNWDWESEYTLFMSALKVNKNNAKLWNNVGHALENEKNFERALKYFLQATHVQPDDIGAHMNVGRTYKNLNRTKEAEESYMMAKSLMPQIIPGKKYAARIAPNHLNVYINLANLIRANESRLEEADQLYRQAISMRPDFKQAYISRGELLLKMNKPLKAKEAYLKALELDRNNADLWYNLAIVHIELKEPNEALKNFNRALELNPKHKLALFNSAIVMQESGEVKLRPEARKRLLSYINEEPLDANGYFNLGMLAMDDKKDNEAEIWMKKAIKLQADFRSALFNLALLYSQTAKELKALPILEELLRYYPDHIKGLILKGDILMNQKKDILGAKKCFERILEMDPSNVQGKHNLCVVYFEEKDLLKAERCLLETLALAPHEEYIQRHLNIVRDKISSSSFIEPIFPTSKISSVEGKKIPTESVKEIRGESRQTQIVKTSDNKSQSKSNKQLGKNGDEETPHKTTKDIKEIEKKRVAALKRLEEIERILNGE

SEQ ID NO: 77 - protein, 344 aa, Homo sapiens
MASGVGAAFEELPHDGTCDECEPDEAPGAEEVCRECGFCYCRRHAEAHRQKFLSHHLAEYVHGSQAWTPPADGEGAGKEEAEVKVEQEREIESEAGEESESEEESESEEESETEEESEDESDEESEEDSEEEMEDEQESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 78 - protein, 128 aa, Homo sapiens
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 79 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 80 - protein, 2912 aa, Homo sapiens
MSSPRLIPLWKDLKLLLNDTINKSKQPSEDPKNCLIVLSDRSQVLFKESRYPQNMPCVCYYFSDAHFFASLSWVTSNTKEIQAVAWMKSKTEDMVEKRTFSMTERLPPIQSMVHAGSFHILVVYCGDLILRLFGDHFRAFKPLGKVPCRFNISCLCYDPEMKMLLSGILGAVVTWVIELGGTGLQIAHMVSMPGDELVQDIVLNGPSGSLLALCETVVRVLMHQGKGQLGEVKRFTSTSSGSSITCCFTCFDQGFLYAGNQAGEIQVWSLQQGHPLHSFQAHQSGVICIRSRPEAHTLLTAGSDSLIKEWNLTSGSLLRRLELGEELYRLQFIDSITFFCQTAHSFSLHRLPCFYSLFNVCGSAPQQLRRVCCGNNWFRILCTTEDGLLRFVSPVTGDLLVITWPFSILDQAVDWAYDPGKEELFVATGSSEVLVFDTTRCPCPAKYLLGTSPNSQDFVQCLAYGHFNLGRGLEGLIFSGHQSGVIRVLSQHSCARLEKFMHFGAVLALSTLSGGIFGGQGNSLLCSYGMDDYVHLSEAVLDGVKVQLRPLASILSSCHLTHLILLPKSVGAITETNCLRLWKFHDFLSSGSQNGLKFIETLPLHLCAITSFDVCLSLSLFVTGSADGSVRIWDFHGRLIGILDSSLHFGPVCFANDRGDLLVTFNQSLYLVSCLKLLPPALLTRLSFMSISDEVLEVPKPFIPSFFFSFETMFVPKYIYPGQAQQKLVGLEKLVNNRAIAFDHSVPHVIEEDEEGSPVLLRSSMHYSLQDMEDWMQVSKRYQCHYVLPPQLQLTSWDGLNPYQILRYYFGHGREWLFAPDCYIPNSVIRARLWPEGTPIYLQCNLHAPQRELEWDRSQEFFFWHSRVRAISNTEYPKNKEEDEHFLEMRLSKDVTYSVLTDGANRSWLGRKMSEITINSMIETMLNIMVHASLLKYQCCVGALGQIFASYQVSPALRSETARRLLNDTTNSNPLIRELAWEGLKRLGMITHLFAMPLAQGLMDKDERVRIKTLSLMAEIGIHSRTSLLQLTQKQETFREMQQQMIGEEPLDHLLGMRATDLQILSTQVEQRLNENLTLSHRDEKPAFSLDVSMPSELKSSLKPPTVSEESEVAIKPSKGQRRGQAGVKKHSQKWLRGLKKTKERDSKQMSTEPGLLEDESGTEAAPIEMEEASVYSQWSSSTSVIKLSKDVDSQEKDISKDHIALTLKRLQKIRDKRDKKATAQKLKKKHKKKGKEAKVINEETTPPVMEQPVTKKVKIQGRGASGISGRRSTAGDGSSWRDDLCRLMALRISGSQTKMSENLNAELVTFAQEMLVDRHPSWELFQEICPLLKKESKVLLEDLDWDVVPPEKKPIFIQEGAIREDMIQGVTQEVIRHKEVMPREEEQAQKKARDMLGLEETQVILKKGKKVIFLEPGNVTMGKEISKKEEKKTFQKSPKQGRKAVQKERKVGKIKREMTKEERDMSEEVEEMATLEEKVVKQEGKLVMIERTPSWQDWKKAWDEWKQVHGETRKSWKAWKEEWEKRLLQEEEKLHQAGEKLSPEEEMLQEDKKLKWEEWKQVWENMLSSKSKEQQYKDEEEVTLEEEVSREGEEKEQQVTEEQRHIQEEHKWARIHRKRARAEKKRAQEERKLAQEEEKLAQEERQLAQEERKLAQAYVKITQDDREMAQAEGKFAQKEETLAQRGEKLSQEAEKLAQKRKKLAKKWEKVAREEEKLAKKGGKLAEVKNILAQKVEELPQREQNLDWQEKELAQELEELEWDMEELSWKEEELNQEEGKLVEEKKKLAEEEEALAWQREKLSEEETKLAQEEELLIQEKEKLAQHKEKMPEEEERLGRKREQLIEKKMKLAQKRERWINSMEELTKNKMILYQKKNLAQEKKNLAQEKEKLAQRKENLLYNKERLTHSKKQLVQVKNKLGMFNKILAQVEEKLTQEKETVIKKKEKLAETEKKLVQVEDSLAKKQEKLAQEKMKLALEKAMVQGKKRLRGELDIAKEEKALNLEMKRLAEEKMRLVEGKETLSKGETPETSRQRKMTQVEQELFERKLSLEEKILLHEDRILAMEESEIAKGKLEFTRGQRIFVQGQRKLAKASRKLIKKRESLSKEPAKLNKILKALQKLTRDERKLTQEEIKMTKMKRALFVKERRLSIEQSKLDIKEWDFSEKRSELTKDEKKLARKQRKLANKMRRMINKEEKMTEEESKLARKHSEVILDDEEEGGIEEEEVIPFLKRRWRKRKEAKRGDKPKEKFSSQVDEVESEEHFSEEMESLLDELEKQESLSSEEEEEREEEEEREEEEEREEEEERKEEEEGEEKQVEKEEEEKKKKKKEKKKEEVQEKEEVFEEKEEIMSEEETESLSDEEEEEESCSLEEEVDREKEILKKEKQFKLQEQRRKSLRGRERVLSILRGVPHGKGRAIRLGVLKSPLKKLMSTALEMKEKTPVPVPEKQISWEDKKATVVEIPRKFLGTMDKEREVMGKYEPIPPHVLGTVLESQAQDLKTPFMSHILRRTVEAEELQHKPLGAWWKWFLQHPPLMGQTEVQLPLSQIPAKEQHADVSLSDVEWIRHVLERMEAGEQLSRDGFHRLCQLLKDLASKGNLEWLHLAKHEAIVYRHRQALESQDTRISSRQSMSPKYLKVIPPIKAKEKESWPKPLAVPTQKSPLATKRIPDPRAKNWHLLGEPYRSERAQQISIAHKEMEMQYFYPATRDIFPSAHASVEKQTLALMFQKDFWDFKDKRRFPKLPKLEKKTQPISKKKEELPLWETFVALYHVLRMLQQRYPKDSTAWMEQFYQLMDLYQLKSPRIQKLLQELLMREEPQPQEIIYEEALKATELVPGERLFCCLFCGSSHTPRSPQEFQGAVPLPWQNCVRTILPVGIARYGILELAWKSLPEADLHLTKALTHTVAPTL

SEQ ID NO: 81 - protein, 606 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

What is claimed is:

1. A method of detecting two or more protein biomarkers, or fragments thereof, in a biofluid sample obtained from a subject having, or suspected of having, a traumatic brain injury, the method comprising the steps of:
   A) obtaining the biofluid sample from the patient; and
   B) detecting von Willebrand Factor (vWF) and Astrotactin 2 (ASTN2) in the biofluid sample by an assay or mass spectrometry.

2. The method of claim 1 further comprising detecting one or more additional protein biomarkers selected from:
   one or more synaptogenesis proteins selected from Annexin A2 (ANXA2), AP-3 complex subunit beta-2 (AP3B2), Bile Acid Receptor (NR1H4), Calmodulin (CALM1), Calmodulin-like Protein 3 (CALML3), Calmodulin-like Protein 5 (CALML5), Carbonic anhydrase 1 (CAH1), Caspase-14 (CASP14), Cadherin EGFLAG seven-pass G-type receptor (CELSR1), Fatty acid-binding protein epidermal (FABP5), Fibrillin-1 (FBN 1), FERM and PDZ Domain-containing Protein 4 (FRMPD4), Histone-lysine N-methyltransferase 2A (KMT2A), Laminin subunit alpha-3 (LAMA3), Multiple epidermal growth factor-like domains protein 10 (MEGF10), Pre-mRNA-splicing factor CWC22 homolog (CWC22), Protein S100-A8 (S100A8), Protein S100-A9 (S100A9), Protein SON (SON), Transmembrane and TPR repeat-containing protein 3 (TMTC3);
   one or more innate immunity proteins selected from Cullin 7 (CUL7), Complement Component C9 (C9), Complement Factor H (CFH), and Complement factor H-related protein 1 (CFHR1);
   one or more metabolism proteins selected from Alpha-1-Antitrypsin (SERPINA1), Arginase-1 (ARG1), Biorientation of Chromosomes in Cell Division Protein 1-like 1 (BOD1L1), Galectin-7 (LGALS7), Gamma-glutamylcyclotransferase (GGCT), metallothionein 1 isoform X (MT1X), and Small Subunit Processome Component 20 Homolog (UTP20); and
   one or more inflammation proteins selected from ATP Binding Cassette sub-family A member 2 (ABCA2), Apolipoprotein A-1 (APOA1), Apolipoprotein B-100 (APOB), Enolase 1 (EN01), Haptoglobin (HP), Protein S100 A7 (S100A7), Serpin B3 (SERPIN B3), Serpin B4 (SERPIN B4), Slit-Robo GTPase protein (SR-GAP1), Serum Amyloid A-1 Protein (SAA1), Serum Amyloid A-4 Protein (SAA4), Serum Amyloid P Component (APCS).

3. The method of claim 1, further comprising detecting one or more, two or more, three or more, four or more, or all additional biomarkers selected from:
   CUL7, or a fragment thereof; MT1X, or a fragment thereof; and SRGAP1, or a fragment thereof; and
   optionally one or more protein biomarkers selected from: Brain-Derived Neurotrophic Factor (BDNF), or a fragment thereof; Glial Fibrillary Acidic Protein (GFAP), or a fragment thereof; Intracellular Adhesion Molecule 5 (ICAM5), or a fragment thereof; Synuclein Beta (SNCB), or a fragment thereof; Metallothionein 3 (MT3), or a fragment thereof;
   Neurogranin (NRGN), or a fragment thereof; Neuron Specific Enolase(NSE), or a fragment thereof; and Aldolase C (ALDOC), or a fragment thereof.

4. The method of claim 3, further comprising detecting one or more protein biomarkers selected from one of the following subsets of biomarkers, wherein the biomarker in the subsets consist of:
   (i) one or more proteins with a cell adhesion function selected from Annexin AI-II (ANXA2), Calmodulin (CALM1), Coagulation factor XII (F12), Disintegrin and Metalloproteinase Domain-containing Protein 8 (ADAMS), Fibrillin 1 (FBN 1), Histone-lysine N-Methyltransferase 2A (KMT2A), Laminin A3 (LAMA3), Multiple EGF Like Domains 10 (MEGF10), Pre-mRNA-splicing Factor SYF1 (XA82), and Low-density Lipoprotein Receptor-related Protein 2 (LRP2), one or more proteins with a cell signaling function selected from 1-phosphatidylinositol 4,5-bisphosphate phosphodiesterase Eta-1 (PLCH1), CELSR1, Fatty Acid Binding Protein 5 (FABP5), Serpin B12 (SERPIN B12), Small Proline-rich Protein 2E (SPRR2), Transforming Acidic Coiled-coil-containing Protein 2 (TACC2), Transmembrane O-Mannosyltransferase Targeting Cadherins 3 (TMTC3), Tripartite Motif-containing Protein 44 (TRIM44), and WD Repeat-containing Protein 87 (WDR87), the cell toxicity protein, Leucine-rich Alpha-2-glycoprotein (LRG1), the clotting protein, HP, one or more cytoskeleton proteins selected from S100A7, S100A8, and S100A9, the extracellular matrix protein, Fetuin-B (FETUB), the gene expression mediating protein, Desmocollin-1 (DSC1), one or more proteins with a gene regulation function selected from Histidine-rich glycoprotein (HRG), Calcium-activated Potassium Channel Subunit Alpha-1 (KCNMA1), Kallikrein-plasma (KLKB1), N-acetylmuramoyl-L-alanine amidase (PG-LYRP2), Proprotein Convertase Subtilisin/Kexin Type 5 (PCSK5), Protein-tyrosine Sulfotransferase 1 (TPST1), Serine/threonine-protein Kinase TNNI3K (TNNI3K), Small Subunit Processome Component 20 Homolog (UTP20), Ubiquitin-60S Ribosomal Protein L 40 (UBA52), and Zinc Finger Protein 652 (ZNF652), one or more proteins with an inflammation function selected from Complement C4A (C4A), Apolipoprotein A-1 (APOA1), Apolipoprotein B-100 (APOB), Enolase 1 (EN01), HP, S100A7, SAA1, SAA4, and Serum Amyloid P Component (APCS), the microtubule trafficking protein, Bile Acid Receptor (NR1H4), one or more lipid binding proteins selected from Apolipoprotein A1 (APOA1), Apolipoprotein B-100 (APO), Apolipoprotein E (APOE), and Enolase 1 (EN01), one or more metabolic enzymes selected from Arginase-1 (ARG1), Biorientation of Chromosomes in Cell Division Protein 1-like 1 (BOD1L1), Catenin Alpha-1 (CTNNA1), Galectin-7 (LGALS7), GGCT, Glutathione peroxidase 3 (GPX3), Metallothionein 1 Isoform X (MT1X), Scaffold Attachment Factor B1 (SAFB1), and UTP20, the protein-binding protein, Group XIIA secretory phospholipase A2 (PLA2G12A), one or more proteolytic proteins selected from ATP Binding Cassette sub-family A member 2 (ABCA2), Cathepsin D (CTSD), Clusterin (CLU), Dispatched Homolog 2 (DISP2), FERM and PDZ Domain-containing Protein 4 (FRMPD4), Neuronal Navigator 3 (NAV3), Pre-mRNA-splicing Factor CWC22 Homolog (CWC22), Serpin B3 (SERPIN B3), Serpin B4 (SERPIN B4), and Slit-Robo GTPase Protein (SRGAP1), the structural protein, 14-3-3 Protein Sigma (SFN), and one or more synapse proteins selected from Calmodulin-like Protein 3 (CALML3), Calmodulin-like Protein 5 (CALML5), Carbonic anhydrase 1 (CAH1), and Caspase-14 (CASP14);

(ii) the astrocyte cell protein, LRP2, one or more proteins found in blood APOA1, APOB, APOE, BOD1L1, KCNMA1, CASP14, F12, C4A, C9, CFH, CFRP1, CUL7, ENO1, SAA1, SAA4, APCS, and ZNF652, one or more proteins found in brain tissue selected from AP3B2, CELSR1, and LRG1, a protein found in epithelial tissue XA82, FBN1, ADAMS, DSC1, the interneuron protein, NR1H4, the neuroepithelial cell protein, KMT2A, one or more neuron cell proteins selected from MEGF10, FABP5, CALM1, CALM3, CALMS, CAH1, SPRR2, TRIM44, and Storkhead-box Protein 2 (STOX2), and one or more ubiquitous proteins selected from SFN, PLCH1, ABCA2, SERPINA1, ANXA2, CLU, DISP2, HP, HRG, KALKB1, LAMA3, MT1X, NAV3, PGLYRP2, PCSK5, CWC22, S100A7, S100A8, S100A9, SON, TPST1, SAA4, APCS, UBA52, and WDR87;

(iii) one or more of the apoptosis proteins CTSD and DISP2, one or more inflammation proteins selected from ABCA2, APOA1, APOB, EN01, HP, S100A7, SERPIN B3, SERPIN B4, SRGAP1, SAA1, SAA4, and APCS, one or more innate immunity proteins selected from CUL7, C9, CFH, CFHR1, one or more membrane repair proteins selected from PLCH1 and GPX3, one or more metabolism proteins selected from ARG1, BOD1L1, LGALS7, GGCT, MT1X, AND UTP20, one or more necrosis proteins selected from CLU, LRP2, and NAV3, one or more neurodegeneration proteins selected from SERPINA1, APOE, and F12, one or more neurogenesis proteins selected from HRG, TPST1, SAFB, TNNI3K, SPRR2, STOX2, TRIM44, WDR87, and ZNF652, one or more synaptogenesis proteins selected from ANXA2, AP3B2, NR1H4, CLAM1, CALM3, CALMS, CAH1, CASP14, CELSR1, FABP5, FBN1, FRMPD4, KMT2A, LAMA3, MEGF10, CWC22, S100A8, S100A9, SON, and TMTC3, and one or more vascular repair proteins selected from C4A, DSC1, and SERPINB12; and (iv) combinations of (i), (ii), and (iii).

5. The method according to claim 1, wherein the traumatic brain injury comprises:
(a) an alteration in cellular or molecular integrity, activity, level, robustness, state, or other alteration of the brain that is traceable to an event;
(b) a condition that results in central nervous system damage, irrespective of its pathophysiological basis; or
(c) a concussion.

6. The method according to claim 1, wherein the biofluid sample is a blood sample, a serum sample, a plasma sample, a cerebrospinal fluid (CSF) sample, a saliva sample, a urine sample, a sputum sample, a secretion sample, or a tear sample.

7. The method according to claim 1, wherein the step of detecting vWF and ASTN2 comprises using an assay selected from an immunoassay, an immunoblot assay, an immunoprecipitation assay, an immunostaining method, a quantitative assay, an immunofluorescent assay, or a chemiluminescence assay.

8. The method of claim 1, further comprising measuring the levels of vWF and ASTN2 detected in the biofluid sample and comparing them to one or more predefined reference levels, or patterns of levels, of vWF and ASTN2 associated with a high risk, a lower risk, or a little to no risk of the subject developing one or more particular brain injury outcomes.

9. The method of claim 1, further comprising measuring the levels of vWF and ASTN2 detected in the biofluid sample and administering a therapy to the subject to treat a traumatic brain injury, when the measured levels of vWF and ASTN2 are above or below predetermined threshold value of expressions for vWF and ASTN2 of healthy individuals, individuals with no traumatic brain injury, individuals with a lesser degree or milder form of a traumatic brain injury, age-matched individuals, and/or sex-matched individuals.

10. The method of claim 8, wherein the particular outcomes are one or more of seizures, chronic pain, chronic headache, post-concussive symptoms, incomplete recovery assessed by GOS-E<8, sleep disturbances, mild to severe depressive symptoms, mild to severe anxiety, post-traumatic stress disorder (PTSD), chronic headache, poor attention or cognitive performance, and motor deficits.

11. The method of claim 3, wherein the innate immunity protein, CUL7, comprises an amino acid sequence of SEQ ID NO. 30; the metabolism protein, MT1X, comprises an amino acid sequence of SEQ ID NO. 50; and the inflammation protein is protein, SRGAP1, comprises an amino acid sequence of SEQ ID NO. 67.

12. The method of claim 1 further comprising administering a therapy to the subject to treat a neurological or brain injury, wherein the therapy comprises one or more treatments for post-traumatic brain injury (TBI) seizures, post-TBI depression, post-TBI anxiety, post-TBI post-traumatic stress disorder (PTSD), post-TBI sleep disorders, post-TBI headache, post-TBI chronic pain, post-TBI oculomotor deficits, post-TBI attention and cognitive defects, and post-TBI balance and gait problems.

13. The method of claim 9, wherein the therapy comprises one or more treatments for post-traumatic brain injury (TBI) seizures, post-TBI depression, post-TBI anxiety, post-TBI post-traumatic stress disorder (PTSD), post-TBI sleep disorders, post-TBI headache, post-TBI chronic pain, post-TBI oculomotor deficits, post-TBI attention and cognitive defects, and post-TBI balance and gait problems.

14. The method according to claim 4, wherein the traumatic brain injury comprises:
(a) an alteration in cellular or molecular integrity, activity, level, robustness, state, or other alteration of the brain that is traceable to an event;
(b) a condition that results in central nervous system damage, irrespective of its pathophysiological basis; or
(c) a concussion.

* * * * *